United States Patent 9,220,755 (MODIFIED POLYNUCLEOTIDES FOR THE PRODUCTION OF PROTEINS ASSOCIATED WITH BLOOD AND LYMPHATIC DISORDERS) - sequence listing, part 20

SEQ ID NO: 22147 - DNA, 1447 bp, Homo sapiens
gccccggcgccccgaagcgggaaaaaggctgggtgccgccgtcccccagctgcgcaaccctaggaactctcgggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggtctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatcca

SEQ ID NO: 22148 - DNA, 2630 bp, Homo sapiens
cccggaagtgcttggccacagtcgcagccccggcgccccgaagcgggaaaaaggctgggtgccgccgtcccccagctgcgcaaccctaggaactctcgggtaggtgggttccgtgtaacggtcagtgtttccggggctccttttcctctgctgcctcccgcagacccaaggctgagtgaggggcggcggcggaagtgggaggcccacccaaaaagccaaatggggtgccagaagagtgaaggcgcaccctggggtcaccctaccctaccccgtcccctcccagccccactctgcgggcgggcgctgcccttttgggcgtcgcagaccctccaaccccggcggcggccttaagattcccgggctgggatccctgctgcagagggggtaacggtgtctggcttgccaagcaatatttgttgtggtctatcatggaagaaataaagtcgggcaatatgaattttttttttctcaaatttgccggatggctgtggtgtttctgactcttagttttctcattgtgaaaaaggaatgattatcttcttcgatcctctcaagagtttccttgttttgagtagattgatagctctttaaaggatgctaagctcagctaatggaagaagagtctagtttctttgaggctttgattttggttaaactatagagctcatacctttctgtatggtgcagcttactattgtctttggattggtaacttaaaaaatacaaataacatgcctttgagaaccaataaaaactatggatattatccctataaatttacacaaatccagatataagcatgcaatgtgatatacctaagggatatgtgaaccactgagttaagaactgctttagagggagatacaatgtgagacacaggctttgggataagactttggtttgaatcctggctctgctctgttaccttagggcaaagttacttaagcatcttgaatctcagcttttttaccaaagcaggactaatactaacttacaaggtggtgaggattaagtgaaagaagatacataaggcacttagcacatagtaggtactcaataagcgatagctaacagatgtctattattattcaaggaattataattttcaaatctgaaatgcagttttaatgtcccataaggtgactaccacatacatttttctcagacttttagtaaactgagttgatttgactttatctcagtactactcttgacctttcacaactttcgtaggttcacagtctctctttttctaggaacttggctgtgttgtcctgcctcagagacaaattcatctattgtaggcctagcccctgcctttgaaaacaaggaaaggttggtagaacatcaacacagcatggaatttccagggaggtctcatttcaaaacttcataaagaacaagaaccacctggacttctgtgagggcgatgattaaactggcctgagtttgaatgaaaggataatgtatgctcaacctgtgactaacaccaaggaggtcaagtggcagaaggtcttgtatgagcgacagccctttcctgataactatgtggaccggcgattcctggaagagctccggaaaaacatccatgctcggaaataccaatattgggctgtggtatttgagtccagtgtggtgatccagcagctgtgcagtgtttgtgtttttgtggttatctggtggtatatggatgagggtcttctggccccccattggcttttagggactggtctggcttcttcactgattgggtatgttttgtttgatctcattgatggaggtgaagggcggaagaagagtgggcagacccggtgggctgacctgaagagtgccctagtcttcattactttcacttatgggttttcaccagtgctgaagacccttacagagtctgtcagcactgacaccatctatgccatgtcagtcttcatgctgttaggccatctcatcttttttgactatggtgccaatgctgccattgtatccagcacactatccttgaacatggccatctttgcttctgtatgcttggcatcacgtcttccccggtccctgcatgccttcatcatggtgacatttgccattcagatttttgccctgtggcccatgttgcagaagaaactaaaggcatgtactccccggagctatgtgggggtcacactgctttttgcattttcagccgtgggaggcctactgtccattagtgctgtgggagccgtactctttgcccttctgctgatgtctatctcatgtctgtgtccattctacctcattcgcttgcagctttttaaagaaaacattcatgggccttgggatgaagctgaaatcaaggaagacttgtccaggttcctcagttaaattaggacatccattacattattaaagcaagctgatagattagcctcctaactagtatagaacttaaagacagagttccattctggaagcagcatgtcattgtggtaagagaatagagatcaaaaccaaaaaaaatgaaccaaaggcttgggtggtgagggtgcttatcctttctgttattttgtagatgaaaaaactttctggggacctcttgaattacatgctgtaacatatgaagtgatgtggtttctattaaaaaaataacacatcca

SEQ ID NO: 22149 - DNA, 1372 bp, Homo sapiens
ttttgcccgcccctccctttctgcgactggctgttaggcgtgggtctccgccccacagccctgcgcctgcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataatagattgtggcttcagatgctgcttactgcttcttaaacctttaaggaacattcttaatacactttatagaattctgaggacaggttttgttttctttcaagttttgaactgcttcattacctataaaaggtctgggtatagctgtagcatttcatttgctttctgagagaaatggacagtttccttggccactgaagatgtttctcacgtaattaaacaacagtttatacatcttgatcctattcttttttttacagtgtgtttctttggagttaaaatggctatgatagcctcatcaaaaacagtcttcaatcccttctgggttaaagctgaacattccacatagcagca

SEQ ID NO: 22150 - DNA, 1061 bp, Homo sapiens
gcgcgtgggcctgggccgcccgtcgtacctgatggtaggaggcagtagttccccgcttcccttccgcgggagggagagttagctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggttttgtaactgctgtcaatctagtactatatttagtagtgaaaccaaatacatcctctaaaagaagttcattatcacacaaggtaactggatttttgaaatgctgtatctactttcttatgtcttgtttctcctttcatgtaatttttgttctgtatggagcaccactgatagagttggcattggaaacatttttatttgcagttattttgtctacttttactactgtgccttgcttatgtttgttaggaccaaacctcaaagcatggctaagagtgttcagtagaaatggagttacatccatatgggagaatagtctccagatcactacaatttctagctttgtaggagcatggcttggagcacttcctattccactggattgggaaagaccatggcagatgacagtagaaagaaaacgtagcacttatagatctctccatgtaccctgcagggggcttggtactgtgaaatgagtaacttaatcctgacaaccgtagtgcaaggtatggcccatctcctgtacgcttggagcgacctttggctacgtggctggccttgttatttcaccactctggatatactggaatagaaagcaacttacatacaagaacaattaactggagcaaagggagatatttctttgtgcagattctgtaagggctgggcagaaatgtgtatggtcaaagccaagcagttccatttacagctctgttttttacgtagttacaacatgatgtgattgtagctttttaaactatgaaacccctgagagattgtaccttctagttgaaataaagtatttataataga

SEQ ID NO: 22151 - DNA, 619 bp, Homo sapiens
gccgcccgtcgtacctgatggtaggaggcagtagttccccgcttcccttccgcgggagggagagttaggtaagccccgctggacgccctcggcgtctcgcctcacgaggtgcaagctacccccgcgaattgccgaagcagccctgagccttggcgccccgacccgccggcgctcgccgtcagctcagcgccactcttccggcgtgccctgatggacagaccccctttcggatccgagttttcgcctctgtcccccagttttcccttgtcttcaactcccatgctctttgatcctgcctctcagctggttcctcgctgcccacgcttgcgccggcgtaggctcgggcagaatcccgagggacccgggttggggtggggctgccggtgaaggtgcggcgatgcccgcgaaggctcctctgggtgccgctcggaagagccttctctccgctgcgctagccatccaagaaaacaccatgaaagataacgatatcaagagactactgtatacccatcttttatgcatattttcaattatcctaagtgtcttcattccatcactcttcttggagaacttctcaatattggaaacacacttgacatggttgtgcatctgttctggt

SEQ ID NO: 22152 - DNA, 1926 bp, Homo sapiens
ggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttacgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcaggtattcatcttaaaccattatttgaatagaatactagtctcacagtttgtacatttttttgaaacattgtattaagaggcaaaagttggtgtttgtaaataaaattacacatttatacccagtcttcactttatgtaggctgtatgcttttcagatttatatgtaaaaactatcaatattagtggaaactaagatcatcgttaggattatgttggagctccaaaagacaatcttgctagtggttcagtttgatacttgccacaaaggcctaaaacttttcccataactggctatcccagcgccataattttctgttaggcctcctggtaacattagggaaaggaatgagaagtgtaaaccaggtactgccttggggagtgaattgtatgtgagtgagcagtgagtgagtacagacatttgtaagagagaggaagttgggagacattggttcactttgggtatgtgaattttagaaatacttataatttgttttattttctctgtaaccatttttaaaggtaaaatactttattagaaataaataatgggtcagtcaatagctactttcttgaaatatataatggcatatgttgttagccatgaaactttgttatttgtgattatctgttgctatctattagaaactcatactatagggaacttttttggattgaaaaatggcaatatatacaattacagcaattttcaaaatttcaaagatttgtaattgagcttatgaatgttgtaggaataaattcaaacactggcacaagatgcttttctttgattctagttacaacagtttctttttttttaattgatgtataatatttgtacatatttttggggtacatgtgatattttgatacctgtgtacagtgtttaatgattaaatcagggtaactggaatatc

SEQ ID NO: 22153 - DNA, 4596 bp, Homo sapiens
gcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtgtgtacatcccgattctggtttaattatcgacatgttgcaaataccctttctgtttatagaagtgtcaagaggctaggtattcctgacagtcacattgtcctaatgcttgcagatgatatggcctgtaatcctagaaatcccaaaccagctacagtgtttagtcacaagaatatggaactaaatgtgtatggagatgatgtggaagtggattatagaagttacgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagctatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaa

SEQ ID NO: 22154 - DNA, 1357 bp, Homo sapiens
aggtgcgggaagtctgaagccggtaaacatggccgtcaccgacagcctcagccgggctgcgactgtcttggcaactgtgttgctcttgtccttcggcagcgtggccgctagtcatatcgaggatcaagcagaacaattctttagaagtggccatacaaacaactgggctgttctggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtat

SEQ ID NO: 22155 - DNA, 4318 bp, Homo sapiens
aggtgcgggaagtctgaagccggtaaacatggccgtcaccgacagcctcagccgggctgcgactgtcttggcaactgtgttgctcttgtccttcggcagcgtggccgctagtcatatcgaggtaactgtggagaattttttacgggtattaactgggaggatcccacctagtactcctcggtcaaaacgtcttctttctgatgacagaagcaatattctaatttatatgacagggcatggtggaaatggtttcttaaaatttcaagattctgaagaaattaccaacatagaactcgcggatgcttttgaacaaatgtggcagaaaagacgctacaatgagctactgtttattattgatacttgccaaggagcatccatgtatgaacgattttattctcctaacataatggctctagctagtagtcaagtgggagaagattcactctcgcatcaacctgatcctgcaattggagtccatcttatggatagatacacattttatgtcttggaatttttggaagaaattaacccagctagccaaactaatatgaatgacctttttcaggtatgtcccaaaagtctgtgtgtgtctactcctggacatcgcactgatctttttcagagggatcctaaaaatgtactgataactgatttctttggaagtgtacggaaagtggaaattacaacagagactattaaattgcaacaggattcagaaatcatggaaagcagctataaggaagaccagatggatgagaaactaatggaacctctgaaatatgctgaacaacttcctgtagctcagataatacaccagaaaccgaagctgaaagactggcatcctcctgggggctttattctgggattatgggcacttattatcatggttttcttcaaaacttatggaattaagcatatgaagttcattttttagacttgatgatgaatgaagaatgcatggaggactgcaaacttggataataatttatgtcattatatatttttaaaaatgtgtttctcttgtatgaattggaaataagtataaggaaactaaatttgaatcaactattaattttataacttaaagaaaaataattgttaatgcaactgcttaatggcactaaatatattccagttttgtattttgtgtattataaaagcgaatgagacagagatcagaatacattgactgtttttgaaaatagtaatttccccttatccccttttcatttggaaaagaaacaattgtgaagacattaaattctcactaacagaagtaactttggttaattattttttgtatatcctcccaatcttttgacttatgcacatattttttcccaatatggagatcatatggaatgtactattttgtaatgtcttttttcattttacaatgtattatcaaccttttccctctcaaaaatacattgtgaatgactgcatagtattcactttatgaatatttaattcatttcacagtcttctattgttggaccacttacattgtaccaaatgttttcctttggtttattctttaatgtattaatattttactgctggtcactcatggaatcctgcagctttaattaaaagcaaagatgaaaaattggttttttaatctatggcactgacaatctccaggaccttatatgtttgttgtcagtttatttgggaaattttagacctttgataatttcacgtactgactgctcaagagaaacataccccattgtttttcatttgtaagcgttctgtgatcttctacaattggtcacgtcctcttcattttccatcttgaaagagagagccaacaaggactttatttcattctgttttaggtaaacctccttgcccactggctgtatctatactttccttgagaaaaatcccataaagtggatggacctgtgaagaaaatgtatgcttatggcctagccttcatgtctggctgatgtatcctataaggcagtaagccccttttctagtctctggtaagatgcaagagctcatatccccatcactgacattttagtttggaaataatattgagactgtgctatgaccaacccctgatgttgttttttcttttcaaacttttgcatatgagtagaggaaaagcctaaaagttaagtatttatgtctggggggataccttcaggtgtcttatctgttttatgcaagaatttatgtgttcatctttattcagtgcaaagatttttttttaaattttgtttataattgtaggtaacattaagacaactcttcctccacaagaaaacctcctaaaattaatattccttaagatttgtttttccttttgcacttataatattaccttttaattgcatgcaagattgtcatacttttcaaaaggcaaaggattgactgtgttatctccctagttagaacaaatgatattgaggctttttgccagctctgaatctttattttaattgatctttttattgatgtgttatataaatgaggaagaaaaattttgtctgattatgtgaaggatctttctgtacatgaaaagaagggaaaataaacttgcaattgaatagactgattatagtagcactgagacacaaaaagattgaccatgttgccctccagacactcatacaaggtcgtggacaccacggtgaggcggagctatttagggtggtaaaggaattatgattgttcttgagccaaagtaatttagtttgaatataatgaaacataccctgtaaagactgctagaaagtaaaaggattcgtcttcagaggttgtagaaggtgcccttcttagttaaaaccaaactgggaaaagtaatactggataaaatattcaggataaattttgcctcagcagaatttcaaagggcagttgttcctctgtttcattattgaatcttcagaatatagttaaagccaaaagcttaaaatatgttaaatgtttcacttataaccataatctttttacatagagcatactctgccttcataataactaaatcctctgcatgtggtagatgagtacgtttaggaaatattgtcagtgcaattaaatggcctacactttaaacagtatcataaaaacaaatccttaaatatattctacttgagtcacaaaagctgaacaacagaaaggtgttttgtttttgcctttctcacagtgttgtggtgagaatcagatgagatagtattttgactaaacacttctgaaattgtaaatatatggtggcattattgttcttatgtcggcttaggaggataccaaaggggaagttaatggtcacagtgcacttatgtagctttctaagctactcaatgtgattcttgttctctttgctgttctttttctcctcccccatggtgtccttcagagagaaaaggaatgtagataaatgaatccctgcagatgtgtcctgacatttcagggagggacagggtataatgatgccatcctgcaaaggcagcctgtgtgagaaaaagaaatcaaataatgtggattttaaaattacgaaagacattcatttgcagtttatgaaaggaaaatgtagtttggatacaaagctgattaaattggatcaagaaatattagaattaaatgcaaaaaataatccatgcatttatggttttgatttttatatattcccagctagttgaaaatgatgattcccacaagaagcataactcagcttgtttctgcttactgagtattttctactatggtatatattgataacatttcttccattatgtatgttgtataccagagttacagttactgtgggaatcataatttgaaattttgactcctgtgtttctggaatctttacaacaaatgttgcattaacatataacttttttcagttgactttaccaaaattaagcccatctttagtagatactgttttaacatgtgaaagaaatacgttataaacataccacaagatatggctataaaacaatgagatcagtatccatttttgctttaaagaattggccttattgcttcagtgtcacatctcatactcaagggcatttactacaaagaaagagttctccaatattgctgttctgttgctgcctgccctatttacacatgtacctgctacttaaataggaaagcctttcaattcatggacaatacaccttggtggtaaccaggcttttatttttatttttttttcttagtgtaaaaactgtactgttttggaaatgtgctgtgaaatattaggtttaactgtgtagatcctagaataaggggatttatatagatgaagttgtaaccaagaaactggttattaaaaatttatttactccaa

SEQ ID NO: 22156 - DNA, 1137 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggccctgcactcagaagggaagttacctaaagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcagatccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttcttcccctgggaaaaaacccaaagaaccaaaaacaaaccaccccaaggataataatagctacactgctagcttctcaagttcttgtgaaaaacaatttacataatgacacagtagatgtggaacacctagcccagtgcctgggcaggtccctattatcataaatgaacataaaagtgctctaaaaacactcca

SEQ ID NO: 22157 - DNA, 913 bp, Homo sapiens
agtgctgcttacccatcatggaagcaatgtggctcctgtgtgtggcgttggcggtcttggcatggggcttcctctgggtttgggactcctcagaacgaatgaagagtcgggagcagggaggacggctgggagccgaaagccggaccctgctggtcatagcgcaccctgacgatgaagccatgttttttgctcccacagtgctaggcttggcccgcctaaggcactgggtgtacctgctttgcttctctgcaggaaattactacaatcaaggagagactcgtaagaaagaacttttgcagagctgtgatgttttggggattccactctccagtgtaatgattattgacaacagggatttcccagatgacccaggcatgcagtgggacacagagcacgtggccagagtcctccttcagcacatagaagtgaatggcatcaatctggtggtgactttcgatgcagggggagtaagtggccacagcaatcacattgctctgtatgcagctgtgagggtgctctgtgctcacgcttcagtctgtgaatgtgctgcgcaagtacatctcccttctggatctgcccttgtctctgcttcatacgcaggatgtcctcttcgtgctcaacagcaaagaagtggcacaggccaagaaagccatgtcctgccaccgcagccagctcctctggttccgccgcctctacattatcttctcccggtacatgagaatcaactcactgagcttcctctgaagccttgaagggttttcagatccaaggaacaaaggggaaaatagacaaaggagtgcagaggacctggcctggcactggcttatttacctgagctcaaggagatccccgctggagcagcctctgcaaaagggagcccatgtaggccaggggctgtccaaactccagcttc

SEQ ID NO: 22158 - DNA, 4322 bp, Homo sapiens
agcggaagcgagaccgtccatccagaggaaggcaagtttttggctcgggcggctgagaagaccgcgcggggctggagacaggtagcagtacgggggcggggcttcatgccggatgtgatagtctgcagtcgtttcggttggcagcctggcgggtgggagatgcggcggccacctgctgcaaagaaccgaagggaaggttagaagtacgaaggcagtttggagctggggctaagcagctgtcgcacggtcagatcatgggctccaccaagcactggggcgaatggctcctgaacttgaaggtggctccagccggcgtctttggtgtggcctttctagccagagtcgccctggttttctatggcgtcttccaggaccggaccctgcacgtgaggtatacggacatcgactaccaggtcttcaccgacgccgcgcgcttcgtcacggaggggcgctcgccttacctgagagccacgtaccgttacaccccgctgctgggttggctcctcactcccaacatctacctcagcgagctctttggaaagtttctcttcatcagctgcgacctcctcaccgctttcctcttataccgcctgctgctgctgaaggggctggggcgccgccaggcttgtggctactgtgtcttttggcttcttaaccccctgcctatggcagtatccagccgcggtaatgcggactctattgtcgcctccctggtcctgatggtcctctacttgataaagaaaagactcgtcgcgtgtgcagctgtattctatggtttcgcggtgcatatgaagatatatccagtgacttacatccttcccataaccctccacctgcttccagatcgcgacaatgacaaaagcctccgtcaattccggtacactttccaggcttgtttgtacgagctcctgaaaaggctgtgtaatcgggctgtgctgctgtttgtagcagttgctggactcacgttttttgccctgagctttggtttttactatgagtacggctgggaatttttggaacacacctacttttatcacctgactaggcgggatatccgtcacaacttttctccgtacttctacatgctgtatttgactgcagagagcaagtggagtttttccctgggaattgctgcattcctgccacagctcatcttgctttcagctgtgtctttcgcctattacagagacctcgttttttgttgttttcttcatacgtccatttttgtgacttttaacaaagtctgcacctcccagtactttctttggtacctctgcttactgcctcttgtgatgccactagtcagaatgccttggaaaagagctgtagttctcctaatgttatggtttatagggcaggccatgtggctggctcctgcctatgttctagagtttcaaggaaagaacacctttctgtttatttggttagctggtttgttctttcttcttatcaattgttccatcctgattcaaattatttcccattacaaagaagaacccctgacagagagaatcaaatatgactagtgtatgttccacaccctctgctactgtgttacattctgattgtcttgtatggaccagaagagagctttgggacattttttctgaacattctaagcattctagtgaaagttcccatgttccaacagaacttaaaagcaatgtttgccttatatataaaagggacacaataattgaggtccaccttctaggaaatcctaggactcgtttatttgggacatggtgggaataaaggtcacatattggaaaatggaaaggctgatgaaactatcagatactaaaacattcttaaaatagaggaatatagttagagacatcaggtttaagccagtatttgttcctgttttacaatgcttctgtcttaagctgtgtcttaacttttaacacccatcttttctttctaaagctttcctgacagctgtgaaaatccaaaaaatattcttaaactgtgtatggtggcccttgcctgtagtctcagcactttgggaggctgaggtgggagggtcgcttgagttcaggagttctagacccacctggggcaagatggtgagacctagtctcaaaaaaaaaaaaaaaaattagccaggtgttgtggtgcacccctgtagtcatagctgcatgggaggctgaggtgggagaattgcttgagcccagagcaagaccctgtctcaaaaaaaaaaaaaaaaaaaaaaaggaaaggacaactttttagatagaaaagtattaaataatactaagatgcttagtagtattattttagagagttttaaacttctatattaaatgtggggtcttacaagataatccaaagactttgggaggccaaggcgggcagatcacgaggtcaggagattgagaccatcctggctaacacggtgaaacccctctctactaaaaatacaaaaaattagccgggcgtggtgggtgcctgtagtcccagctactcctcgggaggctgaggcaggagaatggcgtgaactccggaggtggagcctgtagtgagccgagatggcaccactgcgctccagcctgggcgacagagcaagactccatatcaaaaaaaaaaaaaaaaaaagataatccaaagaatttaaattgtaatcatgtttcatgtatttgttttattacttacttttatagcacttagtcccagtggtattagactgctatttggtttcatacaaaaaggattaaatttaaattcattcatgtttagacttgagttattacatttttaaaactatcatcttgcctttaatgtttgtggtcctacacaaactattagtacatttcagtatcctcttacccctttgtttttaagtttttgattgctaaagcaagacttttttcttctagaatttaagtcaaccaagtgttatctatgttgtaaaaatggataatagtagattttaggtgataaaacaacttgttagtaagacatttcctagcttaaaaaaaaaaatcaaaaattccatgatagaaatgcagacctgtgagggaaactcctgaaaagcataagaagcatcccagagagccatgggttttctagaccagagaatttagagggagattgtggaactgaggcttaggtggtcagatcgtttcccttatcactgtaatatttctgggggaaaaatgctttctgagttgtttaaacaagcatccttacatttttttttttaattaaacagcctgtctaggcttgggattccctaatactacagtagcagtatatgaatatgattttgtgattgtgttttttaaaagataagtaatttgatgaactgttcttttgcagtcagaaaacactcacaaaaagacaaaaaaagttccacagtattatatttcatgtcagttcaggcctaaaatcctttgcaaataagatgtttataggctggtcacaattaacaatgttattattggcagcacttcttggatggataccttttgggacctttcattagaaagagggaaagaatggggtggttttgtatgggctcctgtttggggtaaaaatagcagagtcagttgctgaggacaatgaccttccttataacatttagtttcatacccatattaggtcttgtcttgaggaccctttatatgtgcttgtttactagtggccttccagccatagcattcttacctttttttcctattctaagaattaaaaaaaaaaattatagagccagcaagggaggaggcaggaaacagaaatcgaatttcatcattccagtatagttgtccctttttttgtatttctgacttggttttataattatatttacttactaattattgttttttaacattctttattgtggcttactcttcatacttagaattgaaattgttggacatcacatgtatattcacattataaatacatcattcttccactgttagacctttagattgcttccagtttttaatattctaaataagactttcaacattttctgtgttttagctcattctcttaggacattcttagaagttagaaacatttctgctgggatcgttggagggaacttcaaactttggaatctttcctgcaagaaattctttaccaaagaaaggcaggtgtttcttaaagggatgcaaaagatattttgcactttgtatgttccaaaacatttagtaagttaactaaaaaaatgagttaatttggtttcttgggggattttaattttttaatttgttttctggttatgtaaaaaaaatgttttttttttgcttcttatcacaatccttttgtttcctttttaatcctttaataacaccttcaaattttataag

SEQ ID NO: 22159 - DNA, 4873 bp, Homo sapiens
gagaattatcgcgatagcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagagattcaccaacaatagcaaattacacactggcttggaaagtactcccatgttccgtttgatcttggcaatttaatgctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgt

SEQ ID NO: 22160 - DNA, 4796 bp, Homo sapiens
gagaattatcgcgatagcagcagcggccgggcaggtattgggggcgttccggaattgaggggtggttgtagtggtggcttaggaataccctcccggctatcgcttcagtgggtagaggggaccactgcccgagagctttaatggagctgggtcctgccttcgcgctgaggagccctcgttttcgagatcaggcctgaccgggataagctccagaaacagtattatgtctcagtcctgtgcaaagtgagatgagctgtagcctttggagacctataattttgaacatagatgttccttaaaagctaaatctttttgaacagatgatgataaacctggaagctgttcttgaagactaattagttacactggatatgctgctgttctttactttgggattgcttatacattttgtgttcttcgcctccatctttgacatttattttacatctcctttggttcatggaatgactcctcagtttacaccattgcctcctccagcgagaagattagtgttgtttgttgctgatggccttcgagcagatgcactttacgaattagatgaaaatggaaactctagagcaccgtttattaggaatatcataatgcatgaaggcagctggggcatatctcatacacgtgtgccaacagaatctcggccaggtcatgtagctctgatagctgggttttatgaagatgtcagtgcagttgccaaaggatggaaggaaaatcctgtagagtttgattctctttttaatgaaagtaaatacacatggagctggggaagcccagatatcctgcctatgtttgccaaaggtgctagtggagaccacgtttatacatatagttatgatgctaaaagagaggattttggtgctcaagatgcaacaaaactggatacgtgggtttttgataatgttaaggacttctttcatcatgccagaaacaaccagtctttgttttctaaaataaatgaagagaaaatagtttttttcttacatttattaggaatagatacaaacggacatgctcatcgaccatcctcgagagactacaagcacaatattaaaaaagttgatgatggagttaaagaaatcgtgtctatgtttaaccacttctatggaaatgatgggaaaacaacatttatctttacctctgaccatggaatgacagactggggttcccatggggctggtcatccttcagagactttaactcctttagtcacttggggagctggaatcaagtatccccaaagagtatcagctcagcaatttgatgatgcatttttgaaagagtggagattggagaattggaagaggctagatgtcaatcaggctgatattgcaccattgatgacttcccttattggagttccctttcctcttaactcagtgggaatccttcctgtggattatcttaacaacactgatctcttcaaagcagagagcatgtttacaaatgcagtacagattcttgaacagttcaaggtgaaaatgactcagaagaaagaagttactttaccatttttgtttacaccatttaaactgctttctgattccaaacagttcaacattttaagaaaagcaagatcttatataaaacacagaaagtttgatgaagtggtctccctttgcaaggagctaattcatcttgcattgaaaggattgtcctattatcacacatatgacagattctttttgggcgtcaatgttgttattggttttgtgggatggatatcttatgcctctttgttgatcatcaagtctcattccaaccttataaaaggtgttagtaaagaagtgaagaaaccaagccatctcctgccttgtagttttgtagctattggcattttagtagcattttttctgctgattcaagcctgtccctggacatattatgtatatggtttgttgccactgccaatatggtatgcggttctaagagaatttcaagttattcaggaccttgttgtatcagtgttgacctatcctctgagccattttgttgggtacctgttagcctttaccctgggaattgaagtattagttctcagttttttctaccgctatatgcttaccgctggacttactgcctttgcagcttggccatttctcactcggctgtggactcgagcaaagatgacctcactgagttggactttcttctctttgctcctggcagtgttcccactgatgccggttgtaggtcgaaagccagacatctctctagtgatgggtgcaggcttgctggttcttctgttatccctgtgtgttgtaacatctctcatgaaaagaaaagatagctttataaaggaagagctattggtacatctgttacaggtgctgagcacagtgctctccatgtatgttgtgtatagcactcagagtagtctactcaggaagcaaggactgcctctcatgaatcaaattattagctgggcaacattagcctcttccttggttgtgccactactgagttctccagttctctttcagcgattgttcagcatacttctttcattgatgtcaacctacctacttctaagcacagggtatgaagctctctttccactagtgttgtcttgtttgatgtttgtctggataaacatagaacaagaaactctacaacaatctggtgtttgctgtaaacaaaagctcaccagtatccagttctcttataatactgatataactcagtttcgacagctatatctggatgacatccgtagggcctttttccttgttttcttcttagtgacagcattttttggaactggaaatatagcttctattaacagctttgatcttgcctctgtctattgctttctgactgtgttcagtccttttatgatgggagccctgatgatgtggaagattttaatcccctttgttcttgttatgtgtgcttttgaagcagttcagttgactactcagttatcgtcaaaaagcctttttctcattgttctcgtcatatcagacattatggctttgcattttttcttcttggtcaaggattatggcagctggcttgatattgggacaagcatcagccactatgtgattgtcatgtccatgaccatctttttggtgttcctcaatggcctggcccagctgctcacaacgaagaaactcagactatgtggcaaacccaaaagtcacttcatgtgaggttgctgaagcaccattcagcatctggatcctgattctccttttaagctaaaatctcatcaaggcttcaataagaagatggatatggatatatagtatattctactcctgtaaggaaaatggtatttggaattccgaattgacaggttatctggaacaaaggagcttctttttttttctaggttttgcaggcatgaaatagtgattatatctgtggaaaagcataggaaggcattctcctttttcatttttttcctttggctggcagctcttcccagtgatgttgagagcacctgcagcaatctggtccccagtcgcacaacttcccacatacccagaggagagcatatgcctgtgggggcagtgctgatggcatccagagtcattgctgtggctgagctggaaggaaatcaccaggtgccaccgtcaatatttatcagctttcagcactggttttgttagacagtcagggtgtattatttcaagagcttcaataaaaaaagtgtttgcaggtatttgtcatatttctttagtatgcaataatgctatcttatcctttttagtgctatttctcaggttttctcagtcaaccagctagatgcatgtgatgcatgtctatccttcactttttttttttcatttctggattttcctgggatttctgacaacacaaaagtagaaagtgcttggtatttctgtcttatacataggaaaacatttaaaataaatagtttttaattgtaggctcaacatctgttaccccatagctttttcgtatattgtttctttccctttgaatttctttttactgtcatctattattttaacaggagttaaaataactcctgttaaactttctgacaatatcataagaattcatattaaaggtgttattctttctggttgtgagattctagcacaaaggcctaaaatcatcaaattagatttccatttgtaaacaaattctaatgggcaaaatatcttgagagcagtttttatatggattatccataaaatgacctttacatatccctgcagagttggccttttgcccgtggtgtgctagtagctttggctgatgctaagctttcctggtatgcgccctatttttaagaagtaattgcttttgaattaagttatagcattactaattcatgttaatgactaggaaaccctctgtaatttacaagatttttcaaattggtggggagtgaataaatacaatttaaaagtcagaaatcagtttggcaaagtgtactttcttaatttctatttatgatgaagtatagtcataatttatttgtaatactactttatggtataccagtgaaagaactgtagtataaaaaagaggtattaatgttttatgaaatctcatgcatcagttcatagcataaaatctagctggacaactaagaagctatggtagcaaacagtgatgttgatggaatgagaatcatgaactttcatattacctcaaaggatttttttatcagtttttttcacacatcagaaaaaactgactgtataaacacttatcactgacctttttctatgtgtagttttgccttttatcttttcccaaatttttataaagagaaattaataaatattttattacaacattgt

SEQ ID NO: 22161 - DNA, 2020 bp, Homo sapiens
cacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccatatagcagacttaaaaaaaaaaatcaatgtcagtataatcaagaagttcctccagagaggcatttatattgtaatttgcaaagggcaatgatgtccttcctcctgtttgtcctgaggggcccagaattcaaacccttagtttttgggaagggtacagttagtacttgtgccatcagattcatgtctaagacacaaatatttgttgagtactcactgtgtaccaggtatttttctaggcactgaggatgaagtaatggtaagattctctctcaaagagcttatagttttagaagcagggtgaggcaactaagcaaataaacaaggaaatataatttgatgagtgctatgcaaagaattaagataatgtattctagaatgcaaagggatgactagttcacattgggtggtcaaggaaggcctctcagagagaggctgttgggatctaagtataaagcaggtgaggcaaagaccataaggtgggaaggaacttggtttgtcctaagaacagagagaagactggcattgggcatagagcataccaaacaagagagaatgtggtcccaggtgagcctggagagaccgggcccagattgtgaagggctttgtaggctggtgtaggaagtgtggatttaagtgtaagtgtgatgagtttgaggcactttaggatcaagctgttgggagtcttgaaggaaaggaatgacatggcctgatttctgtttttaaaagtcatcctgattggtgaatgaagaatagattcagaggaggagctgggaaggggacaataaccatatccttacccagtaagcatgagatggataacatgaatctgcttttcctgttccctagtttgtcccagttcctgttattttatggtgagagcatgtcaccacacttaagagcagtataaggggactggatgtggtggttcatgcctgtaatcccagcactttgggaggttgaggcagctggatcacctgaggtcaggagttggagaccagcctggccaacatggcaaaacctcatatctactaaaaatacaaaaattagtcaggcgtggtggcaggcgtctgtaatcccagctactcgggaggctgaggcaggagaattgcttgagcctgggaggcagagattgcagtgagccgagatcatgccactgcactccagccttagcaacagagcgagacggttaccttggcaaccgtctcaaaaaaaaaagaaacaaaaaaaa

SEQ ID NO: 22162 - DNA, 972 bp, Homo sapiens
gagccgcgggatcacgcccgcccccgcgctcgctggctcccacccggggagggtcgttgtgcgcctgcgccagggtgggggttgccgtcgcgcctaggcctttccctcaggttttcctcttccccactgcggctccccagtcggcgcttgcgcggagaactcagcgctgagattgtctaaagccccaggaaaaatggtggaaaattcaccgtcgccattgccagaaagagcgatttatggctttgttcttttcttaagctcccaatttggcttcaaaaatctgaagggatctcgtgtttgctgagtgttccgtgtgccagcactagcctaggaggttttagtctctacaaatatttatacagcaccagacgcgatggcaaagtggataaagcctggtccctgcccttaaggaggtcgtggtcttgtggaggagacagatggtactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccata

SEQ ID NO: 22163 - DNA, 688 bp, Homo sapiens
gaatgggcagggcccggggcctgggcgccgcgacctagtaggcccgcatgctgattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccata

SEQ ID NO: 22164 - DNA, 656 bp, Homo sapiens
ctcagcgctgaggtggccgagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccata

SEQ ID NO: 22165 - DNA, 803 bp, Homo sapiens
ggccgaggtgtcgggaggggcctgggtgggcgtatgaaggacccgaggtcgagggcccccccataccccgcctcgaatgagaaatagaagtctccacgaatgggcagggcccggggcctgggcgccgcgacctagtaggcccgcatgctggtgggcgccgcgcgagccttgttccctgccctcccctcccacagggaggccacgcttgcagagctggagcgcgcgtctatcgccccagaacccccctccctgccctatcctccgccaccccttctgttgcggggcgcgcgccagcctgggtgtctgtatgcgctcgaggcgggggcgcgggttgcggacggaggcgcgggaggcggttctgcgcggcgggggccgtacccgcggcggagcgaggaggcgagaatggatcaatggtgccacggagcacatcgctggcgctgattgtgttccttttccacagattgtctaaagccccaggaaaaatggtggaaaattcaccgtcgccattgccagaaagagcgatttatggctttgttcttttcttaagctcccaatttggcttcaaaaatctgaagggatctcgtgtttgctgagtgttccgtgtgccagcactagcctaggaggttttagtctctacaaatatttatacagcaccagacgcgatggcaaagtggataaagcctggtccctgcccttaaggaggtcgtggtcttgtggaggagacagatggtactttacctcgtgtgggcctttattcctgaatcttggctaaactctttaggtttaacctattggcctcaaaa

SEQ ID NO: 22166 - DNA, 3437 bp, Homo sapiens
tcccacagggaggccacgcttgcagagctggagcgcgcgtctatcgccccagaacccccctccctgccctatcctccgccaccccttctgttgcggggcgcgcgccagcctgggtgtctgtatgcgctcgaggcgggggcgcgggttgcggacggaggcgcgggaggcggttctgcgcggcgggggccgtacccgcggcggagcgaggaggcgagaatggatcaatggtgccacggagcacatcgctggcgctgattgtgttccttttccacagattgtctaaagccccaggaaaaatggtggaaaattcaccgtcgccattgccagaaagagcgatttatggctttgttcttttcttaagctcccaatttggcttcatactttacctcgtgtgggcctttattcctgaatcttggctaaactctttaggtttaacctattggcctcaaaaatattgggcagttgcattacctgtctacctccttattgctatagtaattggctacgtgctcttgtttgggattaacatgatgagtacctctccactcgactccatccatacaatcacagataactatgcaaaaaatcaacagcagaagaaataccaagaggaggccattccagccttaagagatatttctattagtgaagtaaaccaaatgttctttcttgcagccaaagaactttacaccaaaaactgaactgtgtgtaaccatagtaacaccaagcacgtatttatttataagtttttgccattataattttgaccataaattaatttgaccatctctcttattaatagagaagtaaaaaatgtaagttgaccttctcttagattatgttcaatgaatattgtaaatgttcaagtattgttaatgaatagaataaatacaatattgcattcccatatagcagacttaaaaaaaaaaatcaatgtcagtataatcaagaagttcctccagagaggcatttatattgtaatttgcaaagggcaatgatgtccttcctcctgtttgtcctgaggggcccagaattcaaacccttagtttttgggaagggtacagttagtacttgtgccatcagattcatgtctaagacacaaatatttgttgagtactcactgtgtaccaggtatttttctaggcactgaggatgaagtaatggtaagattctctctcaaagagcttatagttttagaagcagggtgaggcaactaagcaaataaacaaggaaatataatttgatgagtgctatgcaaagaattaagataatgtattctagaatgcaaagggatgactagttcacattgggtggtcaaggaaggcctctcagagagaggctgttgggatctaagtataaagcaggtgaggcaaagaccataaggtgggaaggaacttggtttgtcctaagaacagagagaagactggcattgggcatagagcataccaaacaagagagaatgtggtcccaggtgagcctggagagaccgggcccagattgtgaagggctttgtaggctggtgtaggaagtgtggatttaagtgtaagtgtgatgagtttgaggcactttaggatcaagctgttgggagtcttgaaggaaaggaatgacatggcctgatttctgtttttaaaagtcatcctgattggtgaatgaagaatagattcagaggaggagctgggaaggggacaataaccatatccttacccagtaagcatgagatggataacatgaatctgcttttcctgttccctagtttgtcccagttcctgttattttatggtgagagcatgtcaccacacttaagagcagtataaggggactggatgtggtggttcatgcctgtaatcccagcactttgggaggttgaggcagctggatcacctgaggtcaggagttggagaccagcctggccaacatggcaaaacctcatatctactaaaaatacaaaaattagtcaggcgtggtggcaggcgtctgtaatcccagctactcgggaggctgaggcaggagaattgcttgagcctgggaggcagagattgcagtgagccgagatcatgccactgcactccagccttagcaacagagcgagacggttaccttggcaaccgtctcaaaaaaaaaagaaacaaaaaaaagcagtgtaagggaaccagcgaactccaccaagtatagaatgataaataaatcatggtctgtttctacaattgaacactacacagccatgcaaacaagaatgcattacttctctacctaataatatgaattaatatggccataacattgggcaaaaaaagccagacacaaaagagtaaactactgcgtggttccctttatttgaagttcaaaatcaggaaaaactaatctatggtggcaaatattagaataatggttacctttggagaagagtattatctaggaggaggcatgaaggagcctgctggtgaattgaaaatgccctacatcttgatctgggtggtggttatggttacatggaggtaatacatgtttttaaaaaatcattaagttattaagatttctgcttctgatgcaagttacacctcaataaaaaggggaaaaaaaaacagtgcctatgcctacctccagaaaatgttgattcattggtctggagtagagcacaggcaggggtaattttttaacatcttccagatgcttccaatatgcagccagggtcgagaatgactcccttacatgattggactcccttacatgattggactcccttacatgattggactcccttacatgattggactcccttacatgattagacttaactgagttttggtcaagcagggcagtagctgtaagctttggaagagaaagccagcagttatccgagcggttccctcccatctgtgagactcttgctcatgtcagcagtattcccttgtcttcccctcggacaggtgatgggcctgagacgggtttgaaataggtcaggatagaaccttcatggactctagtgttctattgcacattaagcctcaaattaacttttcattctggtttccaaccactctgtccttacaggtcatgaaaggaacaccaatgttttgcaaactatgggcagcagtgtttttgagggtcatgatcagtttagtgtagcaattctctatcttttcttaagatcttaggacccctttattcttgtaaagagtgagagccccaaagaccttttgtgtatgtagatatatttaaaaattaaaatagaaaatttttaaatatttgtttataaataatacgttaccttttagatataaaattaactcatcacataatgagaaacaaaatttctgttacagaaacatttcacccaaatcattgtagtaatactaagctgattctaaaaggacaaatttaacataaacatattcatgagaaataactattttctaaaacaaaaaaattcagtgaga

SEQ ID NO: 22167 - DNA, 1632 bp, Homo sapiens
atggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtcta

SEQ ID NO: 22168 - DNA, 1592 bp, Homo sapiens
cgcgcgcccgccccagttatcatggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgccaaggatggcacagaggccatgctcgtgctcaagtaggcctggctggcacagggctgcatggacctcagggggctgtggggccagaagctgggccaagccctccagccagagttgccagcaggcgagtgcttgggcagaagaggttcgagtccagggtcacaagtctctggtaccaaaagggacccatggctgactgacagcaaggcctatggggaagaactgggagctccccaacttggacccccaccttgtggctctgcacaccaaggagccccctcccagacaggaaggagaagaggcaggtgagcagggcttgttagattgtggctacttaataaatgttttttgttatgaagtct

SEQ ID NO: 22169 - DNA, 509 bp, Homo sapiens
gtctctgtacccactcaccttgtttgtcccaggactcctctatctcctccagcggcagtacatacctgtgaaaatgaagagcaaagccttctggatcttttcttgggagtatgccatgatatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatcctgctcatctctgattacttctatgccttcctgcggcgggagtactacctcacacatggcctctacttgaccgc

SEQ ID NO: 22170 - DNA, 1469 bp, Homo sapiens
atggcggctcccttggtcctggtgctggtggtggctgtgacagtgcgggcggccttgttccgctccagtctggccgagttcatttccgagcgggtggaggtggtgtccccactgagctcttggaagagagtggttgaaggcctttcactgttggacttgggagtatctccgtattctggagcagtatttcatgaaactccattaataatatacctctttcatttcctaattgactatgctgaattggtgtttatgataactgatgcactcactgctattgccctgtattttgcaatccaggacttcaataaagttgtgtttaaaaagcagaaactcctcctagaactggaccagtatgccccagatgtggccgaactcatccggacccctatggaaatgcgttacatccctttgaaagtggccctgttctatctcttaaatccttacacgattttgtcttgtgttgccaagtctacctgtgccatcaacaacaccctcattgctttcttcattttgactacgataaaaggcagtgctttcctcagtgctatttttcttgccttagcgacataccagtctctgtacccactcaccttgtttgtcccaggactcctctatctcctccagcggcagtacatacctgtgaaaatgaagagcaaagccttctggatcttttcttgggagtatgccatgatgtatgtgggaagcctagtggtaatcatttgcctctccttcttccttctcagctcttgggatttcatccccgcagtctatggctttatactttctgttccagatctcactccaaacattggtcttttctggtacttctttgcagagatgtttgagcacttcagcctcttctttgtatgtgtgtttcagatcaacgtcttcttctacaccatccccttagccataaagctaaaggagcaccccatcttcttcatgtttatccagatcgctgtcatcgccatctttaagtcctacccgacagtgggggacgtggcgctctacatggccttcttccccgtgtggaaccatctctacagattcctgagaaacatctttgtcctcacctgcatcatcatcgtctgttccctgctcttccctgtcctgtggcacctctggatttatgcaggaagtgccaactctaatttcttttatgccatcacactgaccttcaacgttgggcagatgggcttctgtggtgatagaatggcaggtacttgtcctgaggccatcagagctgctggtgacaggacaccttcctgaactcctccaggcgcctctgatctctccttagctgctgttgtgttaccttcagatcctgctcatctctgattacttctatgccttcctgcggcgggagtactacctcacacatggcctctacttgaccgccaaggatggcacagaggccatgctcgtgctcaagtaggcctggctggcacagggctgcatggacctca

SEQ ID NO: 22171 - DNA, 2367 bp, Homo sapiens
gtccccgccggggaggtcgggacgggcaggggctgaggaccccgcgccagcttgggagccctggagttctggcgggagggaagctgtcaaatggaagccggtagaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctgggaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaatgcgacattgtttctgatgtttttttttatgatttgtgcatgtatttttatatgaaaaaaacttacaaagatatgcaaattaaacttctttcagttataca

SEQ ID NO: 22172 - DNA, 2713 bp, Homo sapiens
gcttccggccctgtggcctggtggggctctgcaggctccctcgggagtggtccttgggccgtggcccctctggggtgagcgtggatgattagtacccagaagggactgtgtccaaaaggagccggccagaaacgggttgcggacacggctgggctgacagaaggcagcccccacgaggcctttggctctgaggaccctgggtcagagcgacttctccagcctgcgcagggggtgttagtcttacccagagggtccagagctgccgttcaacaggatgtcccagattctcagatagggcccaactaccctaagcatacctagcaagggcaggctgcggcatggaagtactgggctaggcgtttgggtgacctgggtcataatcctggctcggaaagggcgcgtaccctttggcgagggatgcgggctggtaccgtgaggtttaagaagcagaaaacatgacagcctctttaagtagccctgggtacgtcacttgaccccagtgagcctcagtttccatatccataaaatggcgatggtaattatactagcctcacagtgtctgatgagatctctggagcctatttatctcacgggaaaatttttgaagagtgaaactagttgatctaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggcagctggagaggggccgagtctggactagtgtactcctctttgcctttgccactggggtacgctccaacgggctggtcagtgttggcttcctcatgcattctcaatgccaaggctttttctcttctctaacgatgctgaatcctctgagacagctctttaagctgatggcctctctgtttctgtcggtgttcacacttggccttccctttgccctctttcagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctgtgtgtaaatttaaatgtcaatttattgaagtgtaaatttcatcaaaggcattagctgacaggctggtaacagtccacacaagatggtataggcctgaacagtgtagtggcagtaataaagtgggaccattttttccaaatgcgacattgtttctgatgtttttttttatgatttgtgcatgtatttttatatgaaaaaaacttacaaagatatgcaaattaaacttctttcagtt

SEQ ID NO: 22173 - DNA, 608 bp, Homo sapiens
acacccaggacgcagggtgccgctgccggccacagaaaccccaagaatgtttttctttggctattcagaggacatctattgtgtgtcaggccctgtgctgagctgttgttgcctgacagcaggaagagcgcggctctggtttctgtgaagaggctgcgggtcagcctccgactacaagagcctcggcccacaccgggaactcagtgaacgtcagcgggagctggggcaagagcactgactctgagacagcagcctccgctcactatttgaaggcggggtggcggggggccttgaaggagagcgaagtgcgagagaactcttcaggtgtcaccaagaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttg

SEQ ID NO: 22174 - DNA, 716 bp, Homo sapiens
gaaatgagacagacgcccggagaagcggggagccccgcccctccgccatagcagcctcgggcgccgcctcttcctttccagcctcccgccctcgtctgcttccggccctgtggcctggtggggctctgcaggctccctcgggagtggtccttgggccgtggcccctctggggtgagcgtggatgattagtacccagaagggactgtgtccaaaaggagccggccagaaacgggttgcggacacggctgggctgacagaaggcagcccccacgaggcctttggctctgaggaccctggaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatc

SEQ ID NO: 22175 - DNA, 1464 bp, Homo sapiens
ctcgtctgcttccggccctgtggcctggtggggctctgcaggctccctcgggagtggtccttgggccgtggcccctctggggtgagcgtggatgattagtacccagaagggactgtgtccaaaaggagccggccagaaacgggttgcggacacggctgggctgacagaaggcagcccccacgaggcctttggctctgaggaccctggaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaagtattatgcctacacccaattctgtctgccaggctcagcccgccccattcctgagcctttggtacagttagctgtagacaagggctaccggattgcagagggaaatgaaccgccttggtgcttctgggatgttccactaatatacagctatatccaggatgtctactggaatgttggctttttgaaatactatgagctcaagcaggtgcccaattttctactggctgcaccagtggctatactggttgcctgggcaacttggacatacgtgaccactcacccttggctctgccttacacttgggctgcaaaggagcaagaacaataagaccctagagaagcccgatcttggattcctcagtcctcaggtgtttgtgtacgtggtccacgctgcagtgctgctgctgtttggaggtctgtgcatgcatgttcaggttctcaccaggtttttgggctcctccactcctattatgtactggtttccagctcacttgcttcaggatcaagagccgctgttgagatccttaaagactgtgccttggaagcctcttgcagaggactccccaccaggacaaaaggtccccagaaatcctatcatgggacttttgtatcactggaaaacctgttctccagtcacacgatacattctaggctacttcctgacttactggctcctgggactactcctacattgcaacttcctgccttggacatgacctggactctccagggacaggttggaagccaacttaacccaggggtctgaaagtaaaaatacacattggaactgcctctgctgccctgggatcattactgtgtccattataatctttctctttctctttgaaagctggtcaggaatgggagaagtgtcagacactagagagccccttctggtcctggctagggcaaattttagacaactattttctctgtaagtgaagattgtcgtattccaagtctaaaatacacctggatctgtctagtcaatcaacatagcagagacagtcttaaacctaccattgacctg

SEQ ID NO: 22176 - DNA, 707 bp, Homo sapiens
ttacctgtaagcaaagtgtgggctacacacatctgtagtcgctgaggctagagcttgactcgagagaggaaaggaagaatgcaagcatggtcaagtggcagagaggcctgagggagctcaatcctggtagcaacacccctgaattcctggtggtgaaaggatgtggccccaggacccatcccggaaggaggtgctgaggtttgcagtcagctgccgtatcctgactctgatgctgcaggccctcttcaatgccatcatcccagatcaccatgcagaagccttctctcctcctcgcctggccccctcaggctttgtggaccaactcgtggaaggtcttctgggcggcctgtctcactgggatgctgaacacttcttgttcattgctgagcatggctacctgtatgagcacaactttgccttctttcctggtttccccttggccctgctggtggggactgaactgttgagacccttacgggggttactgagtctacgcagttgcctgctgatttcggtagcatcactcaatttcttgttcttcatgttggctgcagttgcacttcatgacctgggttgtctggttttgcactgtccccaccagtccttttatgcagctctgcttttctgtctcagccctgccaatgtcttcctggcagctggttactcagaagctttgtttgccctcctgacattcagtgccatggggc

SEQ ID NO: 22177 - DNA, 2255 bp, Homo sapiens
acgtagaccgtctgctgggggcgccggcaccatttggagtacgtgaggaagaaaaatgtctgaaaagcagatgaaggaagcttttgtcagtaacctcaatggaaccaccgtgctggaaatcacccagggattgtgctttcctgcattctgtatcctgtgcagagggttcctgatcattttctcacagtacttgtgttctttttcacctacctggaaaactagattcctcactgactttgttgtcctaatagttcccatggtagccactttgaccatttgggcttcatttatcctccttgagcttctcggtgtaattatctttggggcagggctgttgtatcaaatataccgaaggaggacctgctatgccagactgcctttcctaaaaatccttgaaaaattcttgaacatcagtctagaatcagaatacaatccagccatctcctgtttccgtgtaattaccagtgcgtttactgctattgctattttggctgtggacttcccactttttcccagaagatttgccaaaactgagctctatgggacaggagcaatggattttggagtaggtggctttgtttttgggtctgcaatggtttgtctagaggtcaggaggagaaaatatatggaagggtccaaattgcattactttacaaactcattgtactctgtttggccattagtcttcctaggaatcggacgattagccattataaaatcaataggctatcaggaacatttaacagagtatggagttcactggaactttttctttaccataatagttgtgaaattgataacaccactgctgttgattatttttcccctaaataagtcctggattattgccctcggcattactgtattataccagctagcccttgactttacctcactgaagaggttaatattatatggcactgatggtagtggcacacgggttggtctattaaatgccaaccgcgaaggaataatctctaccctggggtatgtggcaatacacatggctggtgtgcaaacagggttatatatgcataagaaccgatcacatatcaaagacttgataaaagtagcctgttttcttttactggcagctattagcctcttcatatctctttacgtagttcaagtaaatgtagaagcagtatctcgaagaatggcaaatttagccttttgtatttggatagttgcttctagcctgatccttcttagtagtttattactgggtgatataattttgagttttgccaaatttctaattaaaggagctctagtaccatgttcttggaaacttatccagtcacctgttacaaataaaaagcattcagaatctctagtccctgaagccgaaagaatggaacccagtctttgtttaatcacagctctaaacagaaaacagttaatatttttcttgctgtcaaatataacaactggcctgatcaacctgatggtagatacattacacagcagtaccttgtgggccttatttgtggtcaatctctatatgttttccaactgtttaattgtatatgtactatatttgcaagataagactgtacaattttggtgatcagcaggagtaggatatataagtatttgggcaatatttaatgaggaatattaattgtaaagaaattgtgcttttggcaacagtgttaaccatattttattataaaatagtttcagtcatctaaacagcagtgatgcttaattatttttttttttgagacagagtcttgctctgttacccaggctggagtgtagtggtgccatctcagctcactgcaacctccacctcccgggttcaagcaattctcctgcctcagcctcctgagtagctggcactgtaggcatgtaccaccatgcccagctaatttttatatttttagtagagatggggttttgccatattggccaggctggtctcaaactcctgaactcaagtgataacacccaccttggcctcccaaagtgctgggattacaggtgtgagccaccacactgggccaatgcttaatattttaatgtatctcaacaataaaaccaagaagaaacaaagccttttgacttgttagaatgtattaagtagtattttaaagaaactttatagttgtgacattgaaagactgttggggtggggggaggaaaatttttactttccatcttaatgtaaccttatgctattctgtatttttactgtatattgcttttacaataaatataaaatgaaatgtttatgttgacatttcagtgtg

SEQ ID NO: 22178 - DNA, 359 bp, Homo sapiens
gggacgcctggtccggcttgctggcttcaactacggaagaaaaatgtctgaaaagcagatgaaggaagcttttgtcagtaacctcaatggaaccaccgtgctggaaatcacccagggattgtgctttcctgcattctgtatcctgtgcagagggttcctgatcattttctcacagtacttgtgttctttttcacctacctggaaaactagattcctcactgactttgttgtcctaatagttcccatggtagccactttgaccatttgggcttcatttatcctccttgagcttctcggtgtaattatctttggggcagggctgttgtatcaaatataccgaaggaggacctgctatgcca

SEQ ID NO: 22179 - DNA, 953 bp, Homo sapiens
agcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagctggctccagaagaatgatcagattccggtttgattcctttgacaaaactatagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataa

SEQ ID NO: 22180 - DNA, 3018 bp, Homo sapiens
ggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactacagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgt

SEQ ID NO: 22181 - DNA, 3057 bp, Homo sapiens
gggggccggggctgcaggcagctgggaaccgcgggcgctaggcgcgcgcacccagcactcggtcccagccgataaatctggggcagcgcgcggtaggagctgcgggcggccaggccccttcctgcgtccgcacctggccccgcgcgcccctctcgggcgtccggcttccggcgtcctggcggctcgggtggcggcggttcgggcggccgcctggctgctcctcggggcggcgaccgggctcacgcgcgggcccgccgcggccttcaccgccgcgcgctctgacgccggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaataggccaggcacagtggctcacacctgtaatcccagcactttgggaggccgaggtgggcggatcaccagaggtcaagagtttgagaccagcttggtgaaaccctgtctctactaaaaatacaaaagttagctggggctggtggtgggcatctgtagtcccagctaattggaagggtgaggcgggaggatcgcttgaacctgggaggcggaggttccagagagccaagatcgcaccactgcactacagcctgggcgacagaacgagaccctgtctccaaaggaaaaacaaaaaagaagaataaaataatttggatgaaaatcatgtttatttaaatagtaatgtcatgagactattaaagatgtgccagagtttcaatgaaaatcattaaagtaggacagctaagaaattaatattaatatcaaaattattgataatcttaaattattgattattccttaacgcactccattctccttttacattttatcatgtttcttttgaatatatgaattggcaaaggacttgatgaaactgagtactaagatttggtacagagtatgtcaggaagacaactcagattgccattttaaataaagttgtacatgaacaataattggaatcatcaggtaatttttttaaacaaaggttcttcatttactgttatgattggaaaaaaattagaaaataaagtaagtgccataggctaattaaaaaataaaaccttggccgggcgcggtggcttacgcctataatcccagcactttgggaggccgagacgggcagatcacgaggtcaggagattgagaccatcctggctaacacggtgaaaccccatctctactaaaaatacaaaaaaatgagccgggtatggtggtgcatacctgtagtcccagctactcgggaggctgaggcaggagaatggcatgaacccggaaggcagagcttgcagtgagccgagatcacgccactgcactccagcctgggcgacagagtgagactctgtctcaaaaaaaaaaaaaaaaaaaaaaaaaaaaaagtaaataaaaccttagggcaagcatgttccaaaacagaagacatcaaaccagggtgtgttggcattatttattttatgtagagtattgagatgtgataaacctttgtatatgccatcactgctccatttcctaaagtattttggtgttttcatgggactacatcttgtataatttgacatgtatgacctgactagtcctaacagttctttttaaacgtgtatttgagacttaaatattggaaaaggtaacccagtgccataaagcagaaacagtgacctttaaaatgactaaaatttcaacccagtatagtttcatacctatttcatgctttctcgtaagaaagaatttcatgttttagaaacatttctttcactatgggattaataatatgacactgaaatggaattatatatgtcagctacaattcaggcattgttttgggatatggttagattgacaggcaacgttttggaatatggttagacggggagggaacacggtactgtttaacatcttaagagtatgtgggggtatgtgtatacagaatgtttttgtttttgctcatcacaaccaggtttcatcagtatttaaaatatttaagattgtggcttggaatgtggttcagccatttactcacttatacaaatattcagaagtgtaataaaaatgtgaatgaagaaaa

SEQ ID NO: 22182 - DNA, 1677 bp, Homo sapiens
agagcgtgggagcggtcccggctcccgggcctctcggcgggttgcggggatgtggggacccggcgcgggacctagatcagtagggcgagccggaggaggtcagacactagagccgtgtgccctccttccctcccgtgcgctttgctctgcggcggatcccgggtctccgggagagtcgggctcgggccctgcggttcccaggctggactggccgccctgttactaaagttctgagaaggaaagtcagccgtcaagcgtcttgggatgctcttgagctgcacgaagcttctgatcaccaaggggccaggcaaggccttagcgccctgtgaggcctgagaatccccaaactgaatgtaggactccgtggcaaactgctagttgttcgtgcaagtagtagttggcaaactgcttgtactactgagacgggcaagtgcgggaataattacaataaagggcataagggccatgtgttctgaaattattttgaggcaagaagttttgaaagatggtttccacagagaccttttaatcaaagtgaagtttggggaaagcattgaggacttgcacacctgccgtctcttaattaaacaggacattcctgcaggactttatgtggatccgtatgagttggcttcattacgagagagaaacataacagaggagaagacttcatggcggcggctatggttgccttctgataattgaaggatccctagtggaataaggaacgaatttattgcagacattgtaagcaagaacaactggtaaatgttataggcagtgatggtttcagaaaattttgatatagaggcccctaactatttgtccaaggagtctgaagttctcatttatgccagacgagattcacagtgcattgactgttttcaagcctttttgcctgtgcactgccgctatcatcggccgcacagtgaagatggagaagcctcgattgtggtcaataacccagatttgttgatgttttgtgaccaagctggctccagaagaatgatcagattccggtttgattcctttgacaaaactatagagttcccgattttgaaatgctgggctcactcagaagtggcagccccttgtgctttggagaatgaggatatctgccaatggaacaagatgaagtataaatcagtatataagaatgtgattctacaagttccagtgggactgactgtacatacctctctagtatgttctgtgactctgctcattacaatcctgtgctctacattgatccttgtagcagttttcaaatatggccatttttccctataagttttatgtagttaaatgcttcctagaaacctaaataagatctattaatttctgacgagaggtgttcttctagaattaattacttttatcttttgtcttcatttgtggccaaaattatgtttactagaggaaatttgggatcattctcagctaattccaaaatgtagtgctctattgcatggatccttggtaatcctcaagcatcagatgccataaggggaaacttaattctgctaaattaatgtttattttgtgagaagtgactttatcttcatttggggtagaaaaattatttctttatgtagtagagacaaattattctcattttgcaagtactttcaatttaagctacaaattgagaaaaccgttataaataagaataaaata

SEQ ID NO: 22183 - DNA, 2701 bp, Homo sapiens
agtctccgcgctgctgaggcgcgcccggccgctcccacggcctcccctccgccctgcggtcccgccgcctccggggcctcctgggaccctggccctcgccgggcaggacgccgccagcgctgaaggcgcagcccggaggccgcgcggatgcagatctgtggatccagcgtagcatctgtagcagctgggacatcattccaggttttgggcccggtgtgttggcaacaactggatctgaagatggcagtcagggtgctttggggtggtctcagcctgctccgagtgctgtggtgtctccttccgcagacgggctatgtgcacccagatgagttcttccagtcccctgaggtgatggcagaggacatcctgggcgttcaggccgcgcggccctgggagttttaccccagcagctcctgccgctcggtgctcttccccctgctgatctctggttccaccttctggctgctcaggctctgggaggagctggggccgtggcctggcctggtgagcggctatgcgctgctggtggggcctcgactcctcctcactgccctttcctttgctctggacggggccgtgtaccacctggccccgccgatgggggcggatcgctggaacgccctggccctgctgtctggttcctacgtcaccctggtcttctacacaaggaccttctccaacaccattgagggactcctcttcacgtggctgctggtgctggtatcctcccatgtaacgtggggccctacacgcaaggagccggcgccgggtccacggtggcgcagctggcttcttggaggcattgtggctgctggcttcttcaaccggcccacctttctggcctttgctgtggtccccctctacctctggggcactcgtggagccacaaaccctggtttgaagtctctgacccgggaggccctggtgctgctccctggggcagccctcacagcagcggtgtttgtggccacggacagctggtatttctccagccccgctacatccaggaaccttgtcctgacacctgtcaacttcttgcactacaacctgaatccccaaaacctggcgagacatggcacgcacgcgcggctcactcacctggcagtcaacggcttcctgctcttcggggtgctgcatgcccaggccctgcaggctgcgtggcaacggctgcaagtcggcctccaggcctctgcacaaatgggcctcctgagggcactgggtgcccggagcctgctgtccagccccaggtcctatctccttctcctctacttcatgcctctggccctgctatctgcctttagccaccaggaggctcggttcctgattcccctcctggtccccctggtcctgctttgtagtccacagacgcagcctgtgccttggaagggcactgtggtcctcttcaacgccctcggtgccctcctcttcggctgcctgcatcaggggggcctggtgcctggcctggagtacctggagcaggtggtccatgcccctgtgctcccaagcacacccacccactacacactcctcttcactcacacctacatgcccccccggcacctcctacacctcccaggcctgggggcaccagtggaggtggtggacatgggggggactgaggactgggccctgtgccaaaccctgaaaagcttcaccagacaaccagcctgccaagtggctggtgggccatggctctgccgcctctttgtggtaacccctggcaccaccaggcgtgccgtggagaagtgcagcttccccttcaagaatgaaacacttttatttccccatctgaccctggaggatccaccagccctgtcctccttgctgagtggggcttggagggaccacctcagtcttcacattgtggagctgggggaagaaacctgacaatatgacagagcacccactgcccaagactcagccatagaagatgccgccccaccttctacttgggtagctgggctgggacgctgggacaggaccccgtcctccttcatgactcccactgctgcctctcctgggcatggctgttagctgttctgccttctgggtgagctggcactcttctccctgagaccaaagatttgacctgtcggtcttgatgtcaaggtccccaaagaccaggttaagtgacgacacctgtctgttcctgccctgttgcttccagccactgtgatgtttgaaatatgtgatagtacctggttgtgaaaaaagacaatgaactgctagtgacattcctcaatgacctctcccaaacctcccatgatgccttacccttgctgtcatgacaaccctctggcttcctaagacccatctgcctatcgaaatatgtgcaagtcagtgagacgaagtatagagaacaggtggcccagatccaggggacccaacttctggccccttggtctgtcacctcctcgctgtgtgatcttgagaaagctccttccactcacccaccccacttcccagtctgttgggatcagaggaactttgaggtgtctgccggctaacattgtgtcattcctggagtccacagtacacgtcccctgcctcaacaggcacagctctcacaaagctcttcaagcatggaagtgggagttgtgttgtacttcatggcactctgatgcctgctgtctcagtgtttggttattatgcaaacaagtaatgtttgaaatatataatagcactggagattttctcccta

SEQ ID NO: 22184 - DNA, 3637 bp, Homo sapiens
ttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttattacaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagac

SEQ ID NO: 22185 - DNA, 3637 bp, Homo sapiens
ttgccgcagagacgccccgcccccgcgcggcgctgcggaaccggagctccgggcggcgtcggcagcggcgcgagaggcgacgaggcccgggcggcaggagccggcgcggcgaccgcggcgagggcggcggggacggagcagagcacgacgaagacgcacaggcagccgggccgggccgggccacggggagagcggccggcgggcagcgggcgggaggccgggcgggccgcgggcagccaccgagccgcgaagcgacatggtgctgctcaaggagtatcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttcttccaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaacaaatagaccgtctggtgtcacagagcccgcgtgtgcaggagcctgctcctccgagatacgtggcgtgtaggttgctgtagttacagcgcctccgtctctctccattgtgttccgatccatttctgtgtgttcccccaacctttatttccaagtgacattttcagtctttcaaatagctgccttttgtgatgtggtgatttaaatgatttaagttcatttgttctcaaccttggggtaaactgaggtattttgcttcctgggaagatcttcgcaattttgagtgctcctgtggggagcggggatgagctaaagatacaatgtttccctgccccgcaccgcttccacaaaatagcaatgtggttttgcagctctgacttctgctcccagtaacccatcgttagggcactctagcactatggaggtacccaaggctcagccagtctctatttaagaaaatttaacaaatacgagtaaccctgtcccaatcactgaatctctagttactactcttagaaacacctgtggcttcttggccctcctgttgcccgctctgaatctctctgcagtctacaaaatcgccccagtcaactctccacttggagggaattgtccagtgtggcccctagaattgagtcaccccctagataccaactgtctgaccccgaggagctctgtaagtccctgctcctcctcttccctttggggctggtgctgccactcagcaataatcctcttttctctgtgctttcttaggtccctgtcctctgtctttgaggctggttaggaagcaagagtcctgatctttcatgctgcacaatatgagcatgcaaaaagctttttccagcagaacatgttccctcgtctccagttgccggaaaggaatttggggatcaagaacttagctcgtcctacccccatgttgagttctgccctggaaaacccaaagcaagtagtgatcatagtacagaacccgaccaaagtaggctggtgaggaagtccaggctccaggggaacagacgctgcccagtgttcatagcttcctgcaacttgacagagcctgagtttgcctcttagtgggagaatgagagagagctgtagtgtcacctgacattccccaaaccttgtgaagcacgttggcctaagtgtgccgtgatcccagcccacactagcctgggtgcatctgctaatgggagaccaaatctttgtccgggaagcaagaagtgggtgggagaatgtatcctgtttttgtcagtttgtttgccttactcatttctaagtgcaataagggagtgtctcacaggattgcacctgtgacatcctgatggatgcttccctgtggccctcctggggcaagggtggacagactcagacccccagcatggttagcgctgaccttcattgaggtccctttggaaccagatgtcttgttacagacaccttcctctgtgtaagtctcctcaccttgaggggtctttagtaatgcatctgggtagcatctcaactgctggtagcatttatctgacttggaaagttggagaagaggcattcctactggagaaaaatgtcagtgttttcctataagctctgtgttagctattcattatatttgtgcttaaagatgttccttcattcatcaactaggggaagtccagatgcgggttatcttgaaagaaacaaactgacattctaggcagacagttgtctatgtggtctgagggtcagcagctgttagtctccttcctttggctcttgagacccacacatatcactttagccctaacaagggctcctcccacctccacctgttgccccagttgaaaagcatccattatgagctgaggtcagcctggatctggaattgcagcccacataaacataaaggaggatgtccctggtctgttccatccccacggatggtgttgctgctgggcaacagtgttggcttcttttaagtaccccctttcctcctcacccacctccaaactgactagcactcagagggacttatgataaaggttcagctccaggggtagtacctgagtgtgtgccatgccccttcagaccagctgcttccatcagaattccagggtcacagccccaacagaagcagcagtgcctctgtaggaggggtgctgggctctggccttctcatgcagagaggtccgggacagggtcagtatcgtgggcatgtgtatagcttcccaagttcttttacagtccctgctgggactccctgacttactttggttggttcctagtgctacttgttttacaaactacactttgtagaattgattagattaccttgtttatttaatgtgagtttgtgcctttttgtctcaatcttccaatacaggtatattgagaaaaaaagcagtctaataaaatcctagac

SEQ ID NO: 22186 - DNA, 1002 bp, Homo sapiens
cctgctactttcctgcttggtgtcttgcctttgagtcgagtaatcctgcctgtgtctgtagatgagtatcaagtggggcagctgtattctgtggctgaggccagtaaaaatgaaacgggtggtggcgaaggcgtggaggtcctggtgaatgagccctacgagaaggacggtgagaaaggccagtacacacacaagatctaccacctgcagagcaaagtacccacgtttgttcgaatgctggccccagagggagccctgaatatacacgagaaagcctggaatgcttacccctactgcagaaccgttcttccaaatgagtacatgaaagaagactttctgattaaaattgaaacctggcacaaaccagatcttggcacgcaggagaatgtgcataagctggagcctgaggcgtggaaacacgtggaagccgtatatatagacattgcagatcgaagccaagtgctcagcaaggattacaaggcagaggaagacccagcaaaatttaaatctatcaaaacaggccgaggacccttgggccccaattggaagcaagagcttgtaaaccagaaggactgcccatatatgtgtgcatacaaactggtgaccgtcaagttcaagtggtggggcctgcagaacaaagtggagaacttcatccataagcaagagaggcgtctgtttacaaacttccacaggcagctgttctgttggctcgataagtgggttgacctgaccatggacgacattcgaaggatggaagaagagacgaagagacagctggatgaaatgagacaaaaggacccagtgaaaggaatgacagcagatgactaaagccgcctttcccctctgcactttttgcaagacagtggtcaacaggaagacccagcagctccaccctcccaagtgacaggccattttcggacgcagccgttctgtgcccattcttcaggcaactttcgattccttactgtagctaattctagatgcccttcagtattgtgaaca

SEQ ID NO: 22187 - DNA, 2826 bp, Homo sapiens
tgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacattacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgcc

SEQ ID NO: 22188 - DNA, 2926 bp, Homo sapiens
cgcgcaggcgctgtgagaggcggtagcggcggcggcggcggtggtatcggcggcagctgtgagggggttccgggaagatggtgctgatcaaggaattccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatgcca

SEQ ID NO: 22189 - DNA, 884 bp, Homo sapiens
actgtattcatagcatagcacttccccaccaccccaaattctccctgctttctttccaagtgagttgtctcctctagactgtgagcttcttgagaacagggactgtgtctgcttctagatgcatccccactgcctagaaccgtgtctgacacagagcaagccagcgacctccgggctgcggctttgaggcccacggcgctttcggtgtaactgcgcgaaccaactcctgaacagcccgctttcctgggtctcgaggccaagggcctcttttctcccagagggcctccgtcgggagtgctggccgctcatcctgccgagtcacagccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctata

SEQ ID NO: 22190 - DNA, 590 bp, Homo sapiens
agctgtgagggggttccgggaagatggtgctgatcaaggaattgtgagtgggtctgtgggcgcgagcgaggccgtgggacggcagtgatgggagatttgttgatggagaagtgccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagt

SEQ ID NO: 22191 - DNA, 2852 bp, Homo sapiens
atgggagatttgttgatggagaagtgccgtgtggttttgccatgttctgttcaggagtatcaggttgggcagctttactctgttgcagaagctagtaagaatgagactggtggtggagaaggaattgaagtcttaaagaatgaaccttatgagaaggatggagaaaagggacagtatacgcacaaaatttatcacctaaagagcaaagtgcctgcattcgtgaggatgattgctcccgagggctccttggtgtttcatgagaaagcctggaatgcgtacccctactgtagaacaattgtaacgaatgaatatatgaaagatgatttcttcattaaaatcgaaacatggcacaaaccagacttgggaacattagaaaatgtacatggtttagatccaaacacatggaaaactgttgaaattgtccatatagatattgcagatagaagtcaagttgaaccagcagactacaaagctgatgaagacccagcattattccagtcagtcaagaccaagagaggccctttgggacccaactggaagaaggagctggcaaacagccctgactgtccccagatgtgtgcctataagctggtgaccatcaaattcaagtggtggggactgcaaagcaaagtagaaaacttcattcaaaagcaagaaaaacggatatttacaaacttccatcgccagcttttttgttggattgacaagtggatcgatctcacgatggaagacattaggagaatggaagacgagactcagaaagaactagaaacaatgcgtaagaggggttccgttcgaggcacgtcggctgctgatgtctagatgagtcccctgtagggtcagagacaatgtcaaactgtttacgtaatcaaggtcaagtgaggggaacaagcgcagccagtgatgagtgaagaagaatctgaccagtatcttgcagtgttgacgtttcccagatgtgtgcttgtgatgatacacacacatgcacaggttctcaaccacgtgtgtatatatgtatgtgtgcatatgtctgtagctgtatataaagcgcatgtagagctacagatccagatacacacacttgtgtatatatgtacatacagacatactgaagggattagtacaatttctccaaagtactgtacctatcttcagcaagaatgcaaaagaaaatattttcaatatatatacctggaacagattttaataattatcagagtaataccattaatggacaaattgactgcaatgtaatactagctggtatgtttcataaatgtcaagctgtggaccaacatatatagccttttattatttttctcttcttttaagtcagtctgttataaatttttttttagtcccataagcagtagactcccacagaaaatttcttcaaaattttttggtgttccaatgaatctgggatgtaaactctgaatgtatttataactatttatttctggatggtcattatcttgtagccaaatttgacaatataaagtaaggagcaaagttacaggccagtttttacttgtttgccctgagggaaaaatccttttaaaaaaaatttctggtttttattggatttttgtattttaaatttcaaatatttttctacatcaaacctagcaaaaatggagatgacggtttctgatttataataaatactagacagttttcaggctcctgttagacaaacacattgatgaagaaattagtcttaataggattgtaggctgtgtagaaaagttggaaatatagcacttcatggagtcttgttttgaagatgacagttttctgtaactacagcttggaaactatgcaaatggtctagattcctcagagctcacatgataggatatagttagtgatgacattttgctcttcttgtgggaacacacacttcaaggaggagatagtgactttgagataggaacagtttaagatgcagtgtgagtctggcctgcgtgcggtgaggaggccccgccaagagactggtggacatctgactgtgggatgtgctctcaagtaggacgtcatcaggacagattctgaataggcatcatgagagtgctggtcagaaacggctgccactttttttaatttaattttattttttatttaaaggaaggaacaatagctaggtaagatttttatcagctttctctgtctgaatccagtttttcctctgtcagtcctggaagcttgaatagaattatattgttgaagccttcaggtcacaaactgtcttttgtaacctcctgtccctcctaaaacacgccaacccctgcagtcaaatcacattagtaatctgatttgctgacagtcctgccctgcctgctcctcgttttcccacatgtcctgcatccctcccccactggagtgatttcagtgaatcagacaaggaaggatgtgtaggatcactactgcattgcaataccctgttatcctcagcaacaaaacccacatttcatacatcctttgtgtactcaggataaagactgatgtttactctctgggcactgttgtaagataggttttgtcagagcataatcattgtctgcaaagtgtttggtgcgaggaagattattgctaattttgtgaaataaagagtctagccctctccttttaatgaacttaactctcgctggcatctgtagtatcattgggagcttaggcgcacatggaaatgagagcccggcgcatggattttaatgtttttctaacaactgtggagatttgagggaatgtgtggtgaatgtaaaatacctagtttacttgccagtctcttgtgtaaattacagtaaaacaaagtaaatgaaatttaaacaaaaaataaatttgatcacaaaatg

SEQ ID NO: 22192 - DNA, 6636 bp, Homo sapiens
cggcgccgcgcggccgcgctagaatggaggcgcccagcggcagcgagcccggcggcgacggggccggggactgcgcccacccggacccccgggcccctggcgccgcggcgcccagctccggccccggcccgtgcgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccaagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatacaaa

SEQ ID NO: 22193 - DNA, 6737 bp, Homo sapiens
cggcgccgcgcggccgcgctagaatggaggcgcccagcggcagcgagcccggcggcgacggggccggggactgcgcccacccggacccccgggcccctggcgccgcggcgcccagctccggccccggcccgtgcgcggccgcccgggagtccgagcgccagctgcgcctccgcctctgcgtcctcaacgagatcttgggcaccgagagggactacgtgggcaccttgcgcttcttgcagtcggcattcctgcatcgcatccggcagaacgtggccgactcagtggagaagggcctcacggaggagaatgtcaaggtcctgttctcgaacatcgaagacatcctggaagttcataaggatttcttggccgccttggagtattgtttacacccggagccgcagtctcagcatgaacttgggaatgttttcttaaaattcaaggacaagttctgcgtgtacgaggagtattgcagcaaccatgagaaagccctgaggctgctggtggagctgaacaagatccctaccgtgcgcgccttccttttgagctgcatgcttctgggaggccggaagaccacggacatccctttggaaggctacctgttgtctccgatccagaggatctgcaagtacccgctcctccttaaggagctggccaagaggactcccggcaagcacccagaccaccccgcggtccagagtgccctgcaggccatgaagaccgtttgctccaacatcaatgagaccaagcggcagatggagaagctggaagccctggagcagctgcagtcccacatcgaaggctgggagggttccaacctcacagacatctgcactcagctcctcctgcaagggactttgttaaagatctctgcgggcaacatccaggaaagggccttcttcctcttcgacaaccttctcgtctactgcaagcggaaatccagggtcaccgggagcaagaagtccaccaagaggaccaaatccatcaacggctccctctacatcttcaggggtcgaatcaacactgaagtcatggaggtggagaatgtggaagatgggacagcggattaccatagcaacggctataccgtcaccaacggctggaagatccacaacacggccaagaataagtggtttgtctgcatggccaagacggcagaggagaagcagaagtggctggatgccatcatccgcgagcgggagcagcgcgagagcctgaagctgggcatggagcgtgatgcctacgtcatgattgcggagaagggggagaagctgtaccacatgatgatgaacaagaaggtgaacctcatcaaggaccgccggagaaagctgagcactgtccccaagtgctttcttggcaatgagttcgttgcctggctcctagaaattggtgaaatcagcaagacggaagaaggagtcaacttgggccaagccctgttggagaatggcatcatccaccatgtttccgacaagcaccagttcaagaatgagcaggtgatgtatcgcttccgctacgacgatggcacctacaaggcccgaagtgagctggaggacatcatgtccaagggtgtgaggctttactgccgtcttcacagcctctacaccccggtgatcaaagaccgtgattaccacctgaagacctacaagtcagtgcttcccgggagcaagctggtggactggctgctggctcagggagactgccagactcgggaggaggcagtggcgctcggcgtgggtctgtgcaacaatggcttcatgcaccacgtgctggagaagagcgagttcagggatgagtcccagtacttccgctttcatgctgacgaggagatggaggggaccagcagcaagaacaaacagcttcgcaacgacttcaagctggtggagaacattctggccaagcgcctgctgatcctgccccaggaggaggactatggctttgacatcgaggagaagaacaaggctgtggtggtgaagtccgtccagaggggctcgctggctgaggtggctggcctgcaggtggggaggaagatctactccatcaatgaggacctggtgttcctgcggccgttttcagaggtggagtccatcctcaaccagtccttctgctcccgccgccctctgcgcctcctggtggccacgaaggccaaagagatcatcaaaatccccgaccagccggacacactgtgcttccagattcgtggagctgccccaccgtacgtctatgctgtggggagaggctctgaggccatggctgcagggctctgtgctggtcagtgcattctgaaggtcaatggcagcaacgtgatgaacgatggtgcccctgaggtcctggagcacttccaggcattccggagtcggcgcgaagaggccctgggcctgtaccagtggatctaccacacccatgaggatgcccaggaagcacgagccagtcaggaggcctccactgaggaccccagtggcgagcaggcccaggaggaagaccaggctgattcagccttcccactgctgtccctgggtccccggctgagcctgtgtgaggacagccccatggtcaccctgactgtggacaacgtgcacctggaacacggcgtggtgtatgagtatgtgagcacggcaggcgtcaggtgccatgtgctggagaagatcgtggagccccgcggctgcttcggcctcaccgccaagatcctcgaggcctttgctgccaatgacagcgtcttcgtggagaactgcaggcggctcatggccctgagcagcgccatcgtgaccatgccccactttgagttccgcaacatctgtgacaccaagctggagagcattggccagaggattgcctgctaccaggagtttgcagcccaactgaagagcagggtcagcccacccttcaaacaagcccccctggagccccacccgctgtgtggcctggacttctgccccaccaattgccacatcaacctcatggaagtgtcctaccccaagaccaccccctcagtgggcaggtccttcagcatccgctttggacgcaaaccctccctcatcggccttgacccggagcaaggccacctgaaccccatgtcgtacacccagcactgcatcaccaccatggctgctccctcctggaagtgcttgcctgctgcagagggtgatccccaaggccagggtctccatgatggcagcttcgggccagccagtgggacccttggtcaggaagaccggggcctcagcttcctactcaagcaggaggaccgtgagatccaggatgcctacctgcagctcttcaccaagctggatgtggccctgaaggagatgaagcaatatgtcacccagatcaacaggctgctgtccaccatcacagagcccacctcgggtgggtcctgcgacgcatccttggctgaggaggcctcctccctgcccctggtcagtgaagagagcgagatggacaggagtgaccatgggggcatcaagaaggtgtgcttcaaggtggccgaggaggaccaggaggactcaggccacgacaccatgagttatcgcgactcctacagcgagtgtaacagcaatcgagactcggtcctgtcctacaccagcgtgagaagtaacagctcctacttgggcagcgacgagatggggtctggagatgagctgccctgtgacatgcggatcccatctgacaagcaggacaagcttcatggctgcctggagcacctctttaaccaggtggactccatcaatgctctcctcaaggggccagtcatgagccgggctttcgaagagaccaagcatttccctatgaaccacagcttacaagagtttaaacagaaagaagagtgtacaatccgtggccggagcctgatccagattagcatccaggaggacccctggaacctccccaactccatcaagaccctggtggacaacattcagagatatgtggaagatgggaagaaccagctgctcctggccttgctgaagtgcacagacacggagctgcagctgcgcagagacgcgatcttctgccaggccctggtggccgccgtgtgcaccttctccaagcagctgctggcggccctgggctaccgctacaacaacaatggcgagtacgaggagagcagccgcgacgccagccgcaagtggctggagcaggtggcggccacgggcgtcctgctgcactgccagtccctgctctcgccagccacagtgaaggaggaacggaccatgctggaggacatctgggtgacgctgtcagagctggacaatgtcaccttctcctttaagcagctggacgagaactatgtggccaacaccaacgtcttctaccacattgagggcagccggcaggcgctgaaggtcatcttctacctcgacagctaccacttctccaagctgccctcccgcctggagggtggggccagcctgaggctgcacacagcgctgttcacgaaaggtgagcttcaggcctggggcagggaggaccacgggggccgggccaaggccaccaagcacaccggctcccaaccgcctgcccgcccccgacatctcccctcccagtgctggagaacgtggaggggctgccttctccaggcagccaggccgcggaggatttgcagcaggacatcaacgcgcagtccctggagaaagttcagcagtattaccgcaaactcagggcattttacctggagcggtctaacctgcccacggatgccagcaccacggcggtaaagatagaccagctgatccgccccatcaatgccctggatgagctctgccgcctcatgaagtcctttgtccacccaaagcctggtgctgctgggagtgtgggcgccggcctcatccccatctcctcggagctctgctaccgcctgggggcctgccagatggtcatgtgtggcacaggcatgcagaggagcaccctgagcgtgtccctggagcaggcggccatcttggcacggagccacgggttgctgcccaagtgcatcatgcaggccacggacatcatgcggaagcagggcccaagggtggagattctggccaaaaacctgcgagtcaaggaccagatgccccagggtgctccgcgcctctaccgcctctgccagccgccggtggatggggacctctgaacacccaaatgccccacgctgggccgcggcctctggagctgggatttgggaggacacagcaggcagcgctggccttctccagggatggcccaaggcttccgcagccgcccgttccgggacctgcccagcgtcctccctgcctccttccgggacaagcctggccaccctcgctgtgatgacgagctggctgattggccctgggccggcccattcttcacacgcctgccagaagctggaggggtgctggagacccatagagctgatgggagcagctggtgcctggccttcggctcctgcgtccccagaacccaagggaacgtcatggaggccacatggggccacccggctccctcgggatggctccgcctgcacttttgaaaccccggtttccttcaacgtccacattccaggtgaccacacgtgtctcctcctcctcatcttagcttccaggttcaccctaaccctgtactaacctgcttggtggacttggaaaagacttggctctgtcgggaaaggagagacggggcctccatcacgcctgttaccagaggatccccgagagccacaccagctctggacatcaccgcccctggaactggggccaccagccctgggcacgagatttgctctgactttatttatatggcatgaaatctctggtttattttgggattttttgttgttggtgttgtcaaagtttgttttttctaaagttgtgtgattatatatttgacattttacatttcaaagaaaggtatgttgtctaacaggggaccaacagaaggtagtattgacaactgttcctgcttctactaaaaaaaaaagagcacaaaagaaaaactaaattattgaaaaattaaaaaatgtcattgtttcctgtttgttaatattagggttgtaaggtgtcgttttgaggtatcgactgtgattccttcccccaccctccattctccagcggttggccggtgttagaactcgctctctttgagtgactggctacaagggcctgagaggtggccagccagggttggagctggaggggatggagccccacctgaggtgccgtgtcacacgggttagagggtcactgggaaacaccgggcggtggcttctgtgatttattttcttgatggtaacttctcagagcagggcgattgggacatcaccagccagagcacaggaagccaccctgcctgctggggaggagggacccacacaagccccctcggcagtttgtccccccagcttcggtatgccttcagggaaaggtcacagctggggaggaagcggggggacgcctgtcacccctggcaggtggtgagttcaggtgggggctccctgctgcccccaggcctgggagcttgaagccctcccggcatctggcatccgagcctcccgccctccagggtgcgcttccctctcttgccgcagcatacacgagggcaggcagtggccttgtcactgtatcttgcatcagagacaaaggaggacccgctttagccctgctgcgggaaatgggggagggcccagggccagcgcattgtgcactggtttactttaaaatgtacagattcttctcgttaaattcttgatagattttttattattattaaaagtcagtttataatac

SEQ ID NO: 22194 - DNA, 10750 bp, Homo sapiens
gccagagcagcggggccgggcgcgcagggcctggccggagcccccactcccaggagtttcctctgcagagccccgcgccccccgcgccgggatttcagcccgatcccctcctctccctgcgcccagcctctccccagcatgtaaagtcttctgtctctcctcggagttggcggaggcggcaactttccattctcgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggcattcttacacagaatgaaccagtgtgcagcatcaaaagttgacaaaaatgtgacagaagaaacagtgaagatgttgttctcaaacattgaagacatccttgcagtacataaagaattcttaaaagtcgtggaagaatgcttacaccccgaacctaatgctcaacaagaagtgggaacctgctttcttcactttaaagacaagtttcgtatctatgatgaatattgtagtaaccatgagaaggcacaaaaattacttcttgaactcaacaaaataagaacaatccggacatttcttttgaactgcatgctgcttggaggacggaagaacacagatgttcccttggaaggatatttagtaacaccaatacaaagaatatgcaagtaccctcttattttgaaggagttgctgaagcggactccacggaaacacagtgactatgcagcagtgatggaagccctccaagccatgaaagctgtctgttccaacataaacgaggccaagagacagatggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttggattagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaagttttctcgtgtactgaagaatagggcctggcctacttttaaacaggccaaatctaaaatctccccactgcacagcagtgatttctgccctaccaactgccatgtcaatgtgatggaagtttcttatcccaaaacatcaacctctttgggaagtgcatttggtgttcagttggatagcaggaagcataattctcatgataaagaaaacaaatcttcggagcaagggaaactgagccctatggtgtacattcagcacaccatcacaaccatggcggccccttcaggtctgtctctgggacagcaggatggccatggtctcaggtatctgctaaaagaagaagacttagaaacccaagacatctatcagaaactgctgggcaaacttcagactgcactgaaagaggtggagatgtgtgtttgtcaaatagatgaccttctgtcttcaataacatattctcctaaattagaacgtaagacatcagagggcataataccaacagacagtgacaatgagaagggagaaagaaacagcaaacgggtatgttttaatgtagcaggagatgaacaggaagattctggtcatgacaccatcagcaacagagactcttacagtgactgcaacagcaataggaattccatcgcctccttcaccagcatctgcagcagccagtgcagctcgtatttccacagtgatgaaatggactcaggtgatgaacttcccttaagtgttcgcatatctcatgataaacaggacaagatacatagttgccttgagcatcttttcagccaggtggattcaattaccaatctcctaaaagggcaggctgttgtgagggcctttgaccaaaccaagtatctcactccaggccgaggattgcaagaatttcaacaggaaatggaaccaaagctgagttgtccaaaaaggctacggcttcatatcaagcaagatccttggaatcttcccagcagcgtccggactcttgctcagaacatcaggaaatttgttgaagaggtaaagtgtaggctactcctggctcttcttgaatattcagatagtgagacacagctccgtagagacatggttttctgccagactcttgtggccactgtctgtgccttctctgagcagctcatggcggccttgaaccagatgtttgacaacagcaaggaaaatgagatggaaacttgggaagccagcaggaggtggctggaccagatagcgaatgcaggtgttctttttcactttcagtcacttctgtcaccaaacttgacagatgaacaagccatgttagaagatacactggttgcactatttgatttggaaaaggtttccttttactttaaaccatcagaagaggaacctctggttgcaaatgttcctcttacatatcaagcagaaggaagtcggcaagctctgaaagtttacttctacattgatagttatcattttgaacaacttcctcaacggctgaaaaatggaggagggtttaaaattcatcctgttctttttgcacaagcactagagagcatggaaggatattattacagagacaatgtttctgtggaagaatttcaagctcagataaatgcagcctcactggaaaaggtcaaacagtacaaccagaagctcagggcattctacttggacaagtcaaattcaccaccaaactccacatccaaagctgcctatgtagataagctaatgaggcctctcaacgctttggatgaactttaccgactggtagcctcgtttatcagatccaagcgcacagctgcctgtgcaaacacagcttgcagtgcttctggggttggactgctgtcagtttcctcggagctgtgcaacaggctgggcgcctgccacatcatcatgtgcagcagcggtgtgcatcggtgcaccctgagcgtgacgctggagcaagccatcattctggccagaagccacggactgccacctcgttacatcatgcaggctacagatgtgatgcggaagcagggagcaagagttcagaacacagcgaagaatttgggagtcagagaccggactccacagtctgcaccaaggctgtacaagctgtgcgagccacctcccccagctggagaagaatgaaaagaactcccaagaaaccaggcaggcagaagctcctgaatgctggactagacaaactacatgctggctaaacattctccactgaagatacatcaatgcttttttttttttttttttctgtaaatctttcttcccattgcaaacaagtagtgatcagtttatactttgatatttatgctggaaatggatagaagttcaatcagacagttcagcttcacgaactgatgtctctctgtattgacattaagtattcacttttagagtaaaatccatccctgggacataaagaaaaaaatattagagatttaaaaattaaccaccatgcctcctctcccattcattaaaatggttttattatgcttgttttcatctttcccaagtggacacatgtaataatggagagttcctcttgaagaaggccattattgaagaaacctggcgacatcttgcaaatcatcatgagaaatgttaaggacaatatagactgtgtgctatacattttcagtcccccatttgcaagagagaaagtcattaatgtgtaaaaggtggaaaagcatgctttactctttctcctaagggcttatttcttattagaggagaagaaagctgactaaggcctccagcaggactcactttcttctagctgcctttgggcatcctttattcttgtggacagctctagcaaatcaatgctatttttggtgtctgcaatgggcatggcttccttgggccatgaatactgggtgctgtgccataatggccctggggatcagggaagtgccctggggatcagggaggggaaccaggatgaagaaggggactgtaagcctattttaaaactaaacctttaagttagatacctaaaactcttaattttatgaaggctctcatatgagaggtcagactcttcaaagaatacaccatcatgagaatttttctgttaagatatatgtataagatatgaaaataaggctttatttgtactttaaaaggaccattaggggacttgtaatttatggatgcacaaggtgtattctatccttattctaaagtatatgtaatgtttatcatttctacattgatgcaataacattgtttttagcatagtaaatacagtaatatttattttaaatccataattttcaaacaaaacactcatgattgtgataattatatgggtttacactaatttagtatgtgaaatgcttttcatatctaaattatgtgcaaactattattaattttttttttattttttgaaactgagtctcactctgttacccagactggagtgcggtggtgcaatcttggctcactgcaacctccacctcctgggttcaagccattctcttgcctcagcctcccaggagctgggactacaggtgtgcaccaccatgctcagctaatttttgtatttttagtagagacgtgttttcaccatgttggccaggctggtcttgaactcctgacatcaagtgatccacccacctcagcctcccaaagtgctaggattacaggcgtgagccgctgctcccggcccattattaaattttaatttatgaaatttgatcatggttttcaaactattattaaaacctttatcattaaccattatgtattgaataacaaaaataccatgttacatgtgtaggcaatatgtgtatactactaggtaaggtaataataattgttatttggcacagaagctctagagacttttgtgagaagtccatatacaatgaaaaacaaggaacctaacatcagagttttcaagaaaaagttgaacattttgaatttaataaagatatctttacaaaaataaccttcaaggatttaacatttgtaggactaataaaggaacacagctgattagctagcaagtcctttcatattgtcatgactgttttctcatcaccatcctggaagcagtaatcctcattagaggcatgcaagggtcattaaaatgatttcagttgtactttgccatatttcatggggcaaattatcagctatattgtggtatttataagctaacatattttatatttttaaggatctactttcttcataatagaatgtgcttcatattatttttagggttaaacataagtgtgtcgtctatcatgcttggtacttactaaatgctcaaaaattagtaatggtttatattaacatcagtcactctaacttctgatcgtaataaaaattgtagctaacacttattaagggattactacatgcccagtaatacctccaaatgctttgcctgtattctgttgttattgcttcacttaatcctcataataatgacgtgacatggtactctttttatcgcgcccatttttagagttgaggaaccaaagcaaagaataacccagtgacttgcacaaagtcacatgattgacaaggggtagaaccaaaatttgaacccaggaagtctgccttcttaatgcattatgctacttttccttatcaatataagaactattgtaatattacgatgatttgtaagtaaatttggagttatgcggcatgtgttgtcattaaattatacatcttgtattaaaaaacggtgaatggaaatatgtaaatgctttaattatatgaaaattatagtgtttcctggacattttacaactctggatgcacattttgaggtaactcaacagtgttgcaatctgaaaaactattttgtatcatgttcctcctcatcaaaaataacagttttagatagtacatctcatacaactttattataattccaacacagtggtaagagtaaaaaacatacctaatggatgaatgaataatgacaattttttcaatgccatatgtacctccatgtgacattgggcattaaatggccttgaggttttaggatgtgtttaccttaatgctacatgctcctctataaccagtgcaccttcaaatactgctaaaacctgctaacttcttccaggttctgagcatggacaactcccaccgccccccaacctaaaagggaaggtcatgcatagaaagtttggattttaacttagagcctgactcaaaaataattgtgaactaaaaattcatagtcaatactttttaagcattctattatctcctataattttttctaatattaattccaaatattacaaaatttaatgtgatattaaagtatgaaaaatttgagaagattagaattttacatgtatttccattcctatttaaagagagaaaatggggagataatttctgtgctagttttacttatattggatatataatattgaatttatagtataagctttattttatcagttcgcaaatctgaagtctcatactgttttctgtctctttaaaacacattcttctggtggcttgggttcattgtgcattcattggccactcttcttgcagcaaattttaaatcaatttaaaattaggtaaactttttatgatactataatatatatgacgttgaaatgacattggttctgagtctattaatttaaattttgggatcattacattcagaatgaaatgaaattgaccttgatactaactttgagagccaaaaaaatgaatgggtaaacaaagcctaagggtcatgttaattaatttaacaaaacacactattttcagtcctttgggcttgtacattttatagacaaaattagcatttattgatttggaagtgttcaattgagagtaaatgactctgtgttttgaaactaatacctttgcatttaaaatactgaagtattattttgttagttgaagtagatcttttcctgtgtagcatgatttaatgcagagcagttattcacttatacttctgaaaagccataatattgaaatttaaaatgaatagtcttactttaaggtcacttttactttacattttactttaaaggtcgtttttagactttatgcactagtggtattgaaactaacctttaatatttgactaaattgcttgtgaatttttggaaactatgtttaatttttaaagacattgttatgtgaattatcttactaaattatcacttaagaactctctcatagcagtaatttcattaacacatatatatactaaccaatttgctaaatgaattgtcggttgtcctgcttaagtactagggccaagctttgaaatgacttaaagtgatctgaattttgattgagaaaaataatctgtcttctatcgaatgtttgaacttttagtgatgagcctcagcaaagtttcaccctgcatgaagcagaacaggtgggggaaaattacaagaggggtctgtaccaaaaatggccccaggatattccattgaacaaatattgaccattatcttcctaggtgctacaactccatactagtcattacagttagtctttggtttcacaaaaatgttactgcttcaaaggcttggcattaacagtgatgtcagcattcatactgccaacagtctgctggtcatacatggaagactgttaaagtgtggtctgtgcatcattgagcaattgttatgtagacacaaggcctgcttcactcaggatagcttgctcctctcgctgagaagagatacctgaagtctactaagtctactaaatgagatatatatgtgtatgtatatgcctatatatattattatatttactagtgtttgtgataatgttataaaaattaataagattgttttgttttgtatgaatgtacgacaaatcgagttgttcaatgtattgaatgaatgtcttactgtaagcatcagagctgtccaaccatgtgtaaatgtacctggtcttttgatcactgacactactttgctgttcaatctggaatcaactgacctggctctgccattgagaaataactaatttagaacaaaattgttaaattttaaaattgcatttctactagaaatagctttggagagttaattttaggtgcgaataacaggataaatgctatctgatcaagcattcatccgaaaaatgtttttgagaattcactttgtgcaaggcacagctgttggggctggtatatgtgtggacatgtttgatttgaaaaccttcgtggtgtctctgtgtgttattgatcatctgtgtcttttgcttaaaatggcattatttgtaacacaaacctaatatcatatatacaaatatactgtatgtagccaagaacactaaattggtaagacgctttagaaaatatgcatttgaatttgaatatctaatgcctcaagcaaatttattagagtttcagatgaatatatatttttgtaactggcaagtaaatgagtagaacagagctttttgcctaaaaatatttttataagtactcatttacatagtattcattattttaaatgacaaaatatcaaattggttctataaatagtaattgttttgaatatatccatacttaacatcatatgaaatccaaaatttaatgataaatttcatctggatgtgttattataaaagtcatctttttttcctttgtaaaatatccatgtaacatagcttccattactccatattttatgtatggttaaaattatcaaagtgcattatgtattttatattgtttatttttgtctgcatgaaagattggaatagtaaccgtgtatgataaatgttaataataataaagtgaaatgtagtatgacc

SEQ ID NO: 22195 - DNA, 5400 bp, Homo sapiens
gccagagcagcggggccgggcgcgcagggcctggccggagcccccactcccaggagtttcctctgcagagccccgcgccccccgcgccgggatttcagcccgatcccctcctctccctgcgcccagcctctccccagcatgtaaagtcttctgtctctcctcggagttggcggaggcggcaactttccattctcgccgccgggggccgggcagcagcgggcgcgcgggtcagcgctcagcacggcgggcagcgccgcgctgcgcaccgccgccgaccatgagcgaggacagccgcggagacagccgcgccgagagcgccaaggacctggagaagcagcttcgcctgcgcgtgtgcgtgctcagcgagctccagaagaccgagcgggactatgtgggcacgctggagttcctggtgtcggcattcttacacagaatgaaccagtgtgcagcatcaaaagttgacaaaaatgtgacagaagaaacagtgaagatgttgttctcaaacattgaagacatccttgcagtacataaagaattcttaaaagtcgtggaagaatgcttacaccccgaacctaatgctcaacaagaagtgggaacctgctttcttcactttaaagacaagtttcgtatctatgatgaatattgtagtaaccatgagaaggcacaaaaattacttcttgaactcaacaaaataagaacaatccggacatttcttttgaactgcatgctgcttggaggacggaagaacacagatgttcccttggaaggatatttagtaacaccaatacaaagaatatgcaagtaccctcttattttgaaggagttgctgaagcggactccacggaaacacagtgactatgcagcagtgatggaagccctccaagccatgaaagctgtctgttccaacataaacgaggccaagagacagatggagaagttagaagttttagaggaatggcagtctcacattgaaggctgggaggggtccaacatcactgacacctgcactgaaatgctaatgtgtggagtcttactgaaaatttcttctggaaatattcaagaacgggtgttttttcttttcgataatcttttggtgtactgcaaaagaaaacacagacggttgaagaacagcaaggcatctacagatggacatcggtacctttttcgtggccggatcaacacggaggtgatggaagtggagaatgtggatgatggcaccgctgatttccatagcagtggacacattgttgttaatggatggaagatacataacacagcaaaaaataaatggtttgtttgtatggcaaaaacacctgaagagaagcatgaatggtttgaagctattttgaaagaaagagaacggcggaaaggtttaaaattaggaatggagcaagatacctgggtcatgatctctgaacagggtgagaaactttataaaatgatgtgcagacaaggaaatctgatcaaagaccgaaagagaaaactgactacgttccctaaatgctttcttggaagcgaatttgtgtcatggctgttggaaattggagagattcacaggcctgaggaaggcgtgcacttgggacaagcattattagaaaatggaatcattcaccatgttactgataaacatcaattcaaaccagaacagatgttatatagatttcgctatgatgatggaacattttatccaagaaatgagatgcaggacgtgatttcaaagggtgtaagattatattgtcgtcttcatagcctttttactccagtgataagagataaagattaccatttaaggacctacaaatctgtggtcatggccaacaaactgatagactggttaattgcacagggagattgccgcaccagagaagaggcaatgatatttggcgttggactctgtgacaatggatttatgcaccatgtccttgaaaaaagcgaattcaaagatgaacccctacttttccgttttttttcggatgaggaaatggagggatcaaatatgaaacatcgacttatgaaacatgacttaaaagttgtggaaaatgttatagctaagtcattattgattaaatccaatgaaggcagctatggctttggattagaagacaaaaataaagttccaataataaagttggtagaaaagggatctaatgctgagatggctggcatggaagtcgggaaaaagatttttgctattaatggtgacctagtttttatgagacctttcaatgaagtggattgcttcctgaaatcgtgtttaaacagcagaaaacctctaagagttcttgtgagcacaaagccaagagagacagtgaaaattccagattcagctgatggacttggcttccagatccggggatttggcccttctgttgtgcatgctgtaggaagaggaactgtggctgcagcagctggtcttcaccctggacagtgcattatcaaggtgaatggaatcaatgtcagcaaagagacacatgccagtgtcattgcacacgttacagcctgcaggaagtacaggcggccaacgaagcaagattccatacaatgggtttataatagcattgagagtgctcaagaagaccttcaaaaatctcactccaagccccctggagatgaagcaggggatgcttttgactgtaaagtagaagaggttattgacaaattcaacactatggccatcattgatgggaagaaggagcatgtgagtctgacagtggacaatgtccacctggaatatggtgtcgtgtatgagtacgacagcacagctggcatcaagtgcaatgtggtggaaaagatgattgagcccaaaggtttcttcagcttaactgccaagattcttgaagccctggctaaaagtgatgagcattttgtacaaaactgtaccagcctaaattctctaaatgaagtgattcctactgaccttcagagtaaattcagtgccctttgcagtgaaagaattgaacacctatgtcagagaatatccagttataaaaaggtaagtgttctattgattttatacacaattattgttgaaatgtaccattttactgagatgataacattatataacattttagaacttgtaagaccacctaattctgaattcttcttttcttttctcccaactaagagaatgaaaactctcaatcagaaaaaagttactcacatgaagaaaactaatattcagttgcagttttctcgtgtactgaagaatagggcctggcctacttttaaacaggccaaatctaaaatctccccactgcacagcagtgatttctgccctaccaactgccatgtcaatgtgatggaagtttcttatcccaaaacatcaacctctttgggaagtgcatttggtgttcagtggaaactgagccctatggtgtacattcagcacaccatcacaaccatggcggccccttcaggtctgtctctgggacagcaggatggccatggtctcaggtatctgttagaacgtaagacatcagagggcataataccaacagacagtgacaatgagaagggagaaagaaacagcaaacgggtatgttttaatgtagcaggagatgaacaggaagattctggtcatgacaccatcagcaacagagactcttacagtttcagtgactgcaacagcaataggaattccatcgcctccttcaccagcatctgcagcagccagtgcagctcgtatttccacagtgatgaaatggactcagggagtgatgaacttcccttaagtgttcgcatatctcatgataaacaggacaagatacatagttgccttgagcatcttttcagccaggtggattcaattaccaatctcctaaaagggcaggctgttgtgagggcctttgaccaaaccaagtatctcactccaggccgaggattgcaagaatttcaacaggaaatggaaccaaagctgagttgtccaaaaaggctacggcttcatatcaagcaagatccttggaatcttcccagcagcgtccggactcttgctcagaacatcaggaaatttgttgaagaggtaaagtgtaggctactcctggctcttcttgaatattcagatagtgagacacagctccgtagagacatggttttctgccagactcttgtggccactgtctgtgccttctctgagcagctcatggcggccttgaaccagatgtttgacaacagcaaggaaaatgagatggaaacttgggaagccagcaggaggtggctggaccagatagcgaatgcaggtgttctttttcactttcagtcacttctgtcaccaaacttgacagatgaacaagccatgttagaagatacactggttgcactatttgatttggaaaaggtttccttttactttaaaccatcagaagaggaacctctggttgcaaatgttcctcttacatatcaagcagaaggaagtcggcaagctctgaaagtttacttctacattgatagttatcattttgaacaacttcctcaacggctgaaaaatggaggagggtttaaaattcatcctgttctttttgcacaagcactagagagcatggaaggatattattacagagacaatgtttctgtggaagaatttcaagctcagataaatgcagcctcactggaaaaggtcaaacagtacaaccagaagctcagggcattctacttggacaagtcaaattcaccaccaaactccacatccaaagctgcctatgtagataagctaatgaggcctctcaacgctttggatgaactttaccgactggtagcctcgtttatcagatccaagcgcacagctgcctgtgcaaacacagcttgcagtgcttctggggttggactgctgtcagtttcctcggagctgtgcaacaggctgggcgcctgccacatcatcatgtgcagcagcggtgtgcatcggtgcaccctgagcgtgacgctggagcaagccatcattctggccagaagccacggactgccacctcgttacatcatgcaggctacagatgtgatgcggaagcagggagcaagagttcagaacacagcgaagaatttgggagtcagagaccggactccacagtctgcaccaaggctgtacaagctgtgcgagccacctcccccagctggagaagaatgaaaagaactcccaagaaaccaggcaggcagaagctcctgaatgctggactagacaaactacatgctggctaaacattctccactgaagatacatcaatgcttttttttttttttttttctgtaaatctttcttcccattgcaaacaagtagtgatcagtttatactttgatatttatgctggaaatggatagaagttcaatcagacagttcagcttcacgaactgatgtctctctgtattgacattaagtattcacttttagagtaaaatccatccctgggacat

SEQ ID NO: 22196 - DNA, 3767 bp, Homo sapiens
ggattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttagacctct

SEQ ID NO: 22197 - DNA, 2134 bp, Homo sapiens
gtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcagcatctggaatcaagagacccatggcatctgaggtcttggaagctagacaggattcttacatctcattggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctgg

SEQ ID NO: 22198 - DNA, 3613 bp, Homo sapiens
attttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattccctgcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaatgtaataaactttaatgagttatttaga

SEQ ID NO: 22199 - DNA, 3737 bp, Homo sapiens
gattttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttcttaaggctgaaggaatgaagagagtgggacatggggtaatctttatcccttttgttaaaacaggaggcagccatgggctgggagatcatagcccttcctaggcagaatcctgttcactgccaggctatagtaattattactattttgcaatttgaaatatattctggttgtttttctaaatgtgaagacttaccaaatgaattttagatcattctccagaggagattttttttgctcttctcatcttttccaacagtgttctcctgtttgtggagctaaggtaaagaggggacacttctgtctgtttaacagacagtccatatctgtgaggccagcaaatattttcttaaactcatggggagacagcagattcttgccttggtgaggtcattgctgtgccatatgtcctacccccctgtcttcatgcagggaagttggaaatgggggctacatatgccctctcctccccgtctacaagagttgtggttttccatctgatccttccactcttgtcaggggaagaagggggcctggtatctcaggcagattgttgaattcctgttctatcccttctctatcccaccctgccttgataatatgttagcccataccccaaataactgtctatattagacacccccagccagtttctggctgcctgtctttgctgccatgttttttacaagaaggaaagaattcttgctatttttttttcataatttactatttatgatgtatttaagtgttttattaaggacagagttctgttaggggtgggagggaatatttgagggagggctgggtcttagggaaaggaatggggaagcaacatttttattaagtgttactatttgcctctactttgtattgttcagaaatggcaaatacaatataaaagtgatatatggttttaat

SEQ ID NO: 22200 - DNA, 1252 bp, Homo sapiens
ggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccatatgggtggcatccctgcccggaatagtaaaggggaaaggcttctgctttatattggcatcattgacattctacagtcttacaggtttgttaagaagttggagcactcttggaaagccctggtacatgacggagacactgtctcagtgcatcgcccaggcttctacgctgaacggttccagcgcttcatgtgcaacacagtatttaagaagattcccttacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctccactattgaatttttttcagacccccattcttcatgctggaaatgggattgctggacttggcagctttctttcccctcgtctttgactaggaaccggactcttaatttcctcaggacagactagctggcacattatccctaccttagttctttctctctgactcctggaagaatactcctgtaatctctgtaaaggtttttgggggataagggtgtttaaccacctcccagctttcttcttctttttttttttctgaaaaaaggaaaaagcacacagcacacaatttcaagccattttcagatcagaactccagaagtgttgacaagatgcctattcgtagagttccctcagaagagccatggtgtttatgaagagaagagtagtgattgctctgccagaagcagctcctctttaaactcctcctctcttgatgaatttctta

SEQ ID NO: 22201 - DNA, 353 bp, Homo sapiens
aagagagaatctcttatatgtgctgatacaggtttcaactttctgtgctgtggggtcagtggtaagagagcagcatctggaatcaagagacccatggcatctgaggtcttggaagctagacaggattcttacatctcattggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccag

SEQ ID NO: 22202 - DNA, 2297 bp, Homo sapiens
attttttgcttggctacccggagtgaagcggccgggttgggcgattaacaggccgtggttaggaaggacggagaaggggcgttcgctcctttgggacttttcatgcctcgtttttttttcagatgtggcttggtctgggcgcaaggtcccagcagccagcttaagcttactcttctgtgaaaggggaaagtatcccctgtggaaagcggttaaacttgtggagggggtgcgggacgtgagttcttccccatgccaggcgaatggtgtggccttgagctggtccaggagccggctcgacgtgtctgagggaggccccggagggggcggggaggtggcccacagaacgcgggttctgtaaagagacgttgggaagattcgattccgagaagaggaagaaccggattgaaagagagccaggccgctgagggggagggggctgctaagatggcgtcggcctcctccgggccgtcgtcttcggtcggtttttcatcctttgatcccgcggtcccttcctgtaccttgtcctcagcagcatctggaatcaagagacccatggcatctgaggtgccttatgcctctggcatgcccatcaagaaaataggccatagaagtgttgattcctcaggagagacaacatataaaaagacaacctcatcagccttgaaaggtgccatccagttaggcattacccacactgtggggagcctgagtaccaaaccagagcgtgatgtcctcatgcaagatttctacgtggttgagagtatcttctttcccagtgaagggagcaacctgacccctgctcatcactacaatgactttcgtttcaagacctatgcacctgttgccttccgctacttccgggagctatttggtatccggcccgatgattacttgtattccctctgcagtgagccgctgattgaactctgtagctctggagctagtggttccctattctatgtgtccagcgacgatgagttcattattaagacagtccaacataaagaggcggaatttctgcagaagctgcttccaggatactacatgaacctcaaccagaaccctcggactttgctgcctaaattctatggactgtactgtgtgcaggcaggtggcaagaacattcggattgtggtgatgaacaatcttttaccaagatcggtaaaaatgcatatcaaatatgacctcaaaggctcaacctacaaacggcgggcttcccagaaagagcgagagaagcctcttcccacatttaaagacctagacttcttacaagacatccctgatggtctttttttggatgctgacatgtacaacgctctctgtaagaccctgcagcgtgactgtttggtgctgcagagcttcaagataatggattacagcctcttgatgtcaatccataatatagatcatgcacaacgagagcccttaagcagtgaaacacagtactcagttgatactcgaagaccggccccccaaaaggctctgtattccacagccatggaatccatccagggagaggctcgacggggtggtaccatggagactgatgaccagtttgttaagaagttggagcactcttggaaagccctggtacatgacggagacactgtctcagtgcatcgcccaggcttctacgctgaacggttccagcgcttcatgtgcaacacagtatttaagaagattcccttgaagccttctccttccaaaaagtttcggtctggctcatctttctctcggcgagcaggctccagtggcaactcctgcattacttaccagccatcggtctctggggaacacaaggcacaagtgacaacaaaggcagaagtggagccaggcgttcaccttggtcgtcctgatgttttacctcagactccacctttggaggaaatcagtgagggctcgcctattcctgaccccagtttctcacctctagttggagagactttgcaaatgctaactacaagtacaaccttggaaaagcttgaagttgcagagtcagagttcacccattaagcgcaaagcctcagaagacctggaacaagattctgccatctctgtgatcccaagatgtcagcccttgccccagcaatgctgaattttcttctacttggtcatcaaaaaaggagtgtaatagaagtgaggggagctgctcctccatcttcttcctgaagaagaaccttctctccttcctcttcctcatgaatgggccttagtgcctcagagagttgaggaccgcagcatcccctccactccagagttgggtggtatggattttcaactggccaaccctttgcctc

SEQ ID NO: 22203 - DNA, 2654 bp, Homo sapiens
aacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctca

SEQ ID NO: 22204 - DNA, 612 bp, Homo sapiens
gctgaacccaagagactgatgtattgcccagactcctgcacgctgtctgccagccacagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatga

SEQ ID NO: 22205 - DNA, 2654 bp, Homo sapiens
aacttgcagactgtggcgcaactggtcttggtagcggaggcacccgaatgctgcccgggtgaggtaaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagcaaagggttaccttccagttcaacatttaccttggaagaggggaccatctacttgaccgctgagcccaacactctggaagtgcaggatgacaatgcttctgtgcttgacgtctatttataagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcattatttcattgtgcatgcatccagtgattatacataagcaacatatgtaatctgcttatatatttttaaaaatccatccacacacatggtaaattaagtataaattcttttgcaaaattatagttcatgtcattgaaagtttaaattggtttcatttaaagatcaatatactaggtctgccttcactttatagaaaactagcttctataaagattttttcactgtttactagtgaaatgagaaaagcaaagctatttataaaaggccttatgtcgtgtacatacattgtctttgaaatatttgtgatctagtttattgcttgtaaaagagaaattatataatttatttagtaaatactactgtaaactatagttttgtgagagaaataaaatattttgttctca

SEQ ID NO: 22206 - DNA, 1811 bp, Homo sapiens
aacttgcagactgtggcgcaactggtcttggtagcggaggcacccgaatgctgcccgggtgagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagtaaa

SEQ ID NO: 22207 - DNA, 791 bp, Homo sapiens
cgaaagcccaccaatccattgtggaatgacctctacaaatagttttgcttctgcacaaccagatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatc

SEQ ID NO: 22208 - DNA, 813 bp, Homo sapiens
agtgcattccaagttctaaacagctgagttttggatctcagctcctttgagagttgtggaccagtcagacacaaaattatctttaaatatacagatagggatgaggaagccaaggcccagcagagctgagatgtgactgcagagccgtccaaccccagtcctgtgacctttctctggtgcctgatacctctcagcatttgagggccttttctcttcctgcttcatctctaaaggtccttctaggagagaggtgaaagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatg

SEQ ID NO: 22209 - DNA, 2019 bp, Homo sapiens
actgctctcccttcgctgtggggaagcgacaacgtcccgataacttgcagactgtggcgcaactggtcttggtagcggaggcacccgaatgctgcccgggtgagaaacctggcaaagaaaacggtctcgacaatgagtaggccacccatcactactaactacagatgacttgccatttcatttacaaagatgtcttctgctgctgaaaatggagaggcagcacctggaaaacaaaatgaagaaaaaacctataaaaagactgcatcatctgctattaaaggtgctattcagctgggaataggatacacagtgggtaatctcacttccaagccagaacgagatgttcttatgcaagacttttatgtggtggaaagtgtgttcctacccagcgaagggagcaatctgaccccagcacatcactacccagactttagatttaagacatacgctccattagcattccgatatttcagagaactttttggtatcaagcctgatgattacttgtattccatctgcagtgaacctctaatagaactgtctaaccctggagccagtggatccttgttttttgtgaccagtgatgatgaatttatcatcaaaacagttcagcacaaagaagctgagtttcttcagaagctactgccaggctattacatgaatttaaaccagaatccaaggactcttttgccaaaattttacggactgtattgtatgcaatcaggaggcattaatatcaggattgtggtgatgaacaacgttttgccacgctccatgagaatgcactttacatatgacttgaaaggctcaacgtataagcgaagagcatcccgtaaagagagagagaaatccaaccccacatttaaggacttagatttcctgcaagacatgcacgaagggttgtattttgatacggaaacatacaacgcgcttatgaaaacacttcagagagactgccgggtgctagaaagcttcaagatcatggattatagccttctgttgggaattcatttcctggaccattccctcaaagagaaagaggaggagaccccacaaaatgtgcctgatgctaagcggactgggatgcagaaggttctctactcaacagccatggaatctatccagggtccagggaaatctggagatgggataatcacagagaacccagacacaatgggaggcattccagctaaaagccataggggagaaaaactacttttatttatgggcattattgacattctgcaatcatataggttaatgaagaagttagaacattcctggaaagctcttgtttatgatggggacactgtttctgttcatagaccaagcttttatgcagacagatttcttaagttcatgaattccagagttttcaagaaaattcaagctttgaaggcttcaccgtctaagaaacggtgcaattcaatcgccgccctaaaggccacttcacaggagattgtgtcctcaattagccaggaatggaaggatgagaagcgggatttgctgactgaaggacaaagttttagcagccttgatgaagaagccctgggatcccgacacaggccagacctggtccctagcactccatcactgtttgaagctgcttccttggcaaccacaatttcatcttcttccttatacgtcaatgagcactatccacacgacaggcctacactctattcaaacagtaagtgaaaatggtgatcacctaagcacatggatgagacgtgagcacagttatggcagagaagtttctccgcaccagaattatccacagcaacttggctgagccccactacacacagagaaatcatcaacctgacttaagagttttcaagatgtcaacttcaggctgatcagcagatgggatgtgaaaaatactaccctattctatcatttgctgttgcttgctgaactgtgaagaactgcatgaactatatttaagctgctttctgtaccattgccaatcacctttttggagttggaagtgctattttcctatggacttttgcatta

SEQ ID NO: 22210 - DNA, 5047 bp, Homo sapiens
gcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctactttcccaccgatgagaggagctgggtgtactccccgctccactatagcgcccaggcccccccggcctccgacggcgagagcgacacataatttctatgcagcccccgacccagagccgagctccacttctgctccggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgttttaggaaaagaacaaaaaagacacaaacaaaccaaccagagggagaagagcccctgcccactgcactctttggttctctgctgtgcctgcctgtgtcctgaggaagaagccaggctgttcgcggtggcctctggggacctgagccccgggggccccatcggcctgcagaggggacggctggggtcccgagcaactctgcctccatccacgtgggaagcggaccctcctgccctcagcttgggtttgggggcctcagtgcaggacatctggcctgaacatcgactgtggggacagccctcgccctgccaagcactgcggccactcagcagctatgttcccgccgcagtggggccctgacgcccacctcccaggtgcccctcgagcaaaaacctctggcgcctccaatccagacccaccacagctggagggccaggcctcctcttccccaggctgccacccacgctggcggagctcagggctggggacttgtccttctcttccaacgtaggccactcagcaactggcatggagggcccaggcaacggagacgttttctccatggcaggacagagcgggaggccgggccttgggccacaggagaccagctcagggcggaaggtcaggctccccgccccctccacgtggagacatggcctagggggccaggcccggctccacaggagtctccttcaggactggtgtggatgtccgccgcctctttcttgtttaagtgatgtgatgtctccgaggaggggagagaagactttgtttccgactcatcaccctccaagagggcagcgctcccagtggtgggactcagcccagactgccctggggcagcttcctgggcccgctgcgctcagagggtgctggttggaggccagagctcggcagagtcacccaccctgcccttccccaggacccctgagaggggcttattggtgatggctgtgggaatcccccacttccaagatgtgcccaggatgtgaggagctggagtggaagctgcacctttgggaagaattcctctccagacctggcagagcctggtgtggggtctgagacggccggagaacctcccaggcagggctctgtgttttgtctgttacaacctccgtatgacgccacgccacccgctgttcacgtcccgtcggcctcctgcacagcccacacgctgcgcccggaaggcccctgctgtggagaagccggacccatccccgaggtccccagcgaggacacacactccacgagagcagcccctccactctgcccaggagaggggccgaccctcctcgggaaccggccagccgcgtggctcccagcatccatcaggacaagcccacgtggggtcctccctgcgtgctcagagggtctgtccagccctgggaagcgaccttggcctcagttcacagcctggtgctcatctgctggcaccgggcatccacccatcagcccccgccctgtccctccgaaggacacccagcaggcaccccccggggaggcaggggcagaggtcagaaggggtgtctgggacctggatggccagcagggacaggggcattgtcatctcaaaggcccaacccccagaggccacaccagtcctcccagggagtcctcgagtcgccctgcccagagccctggcaccagagacgccaagagcctgtggggtgactcggagcagcaggtgtggccccgggcgggcggcaccgcgtccagggcagcctccctccgctgagtgacacgggacaccagtgcccggccgacgcgcctttgcaggagaaatgtgcaaacctctgtggataccatttcatttccattcttgtgttgtctccaaggcccttttggagatatacttggtgttggttgtgttttttggttccttttcagagaactgtaaaccgaggctgacgtgctccactgactgtgccgaggggcgggggcaggaggacggcaagacctatttataatatttagcgaactcggtctccctcagatcccccgcgagggaggctgctggacccaccccgctgtcccccatgatagaagtctgtaaataccttggtgaccaatgcccacttcccctcctgggtcacctctgatggctgctgtccactgagaacgtgggcagtgtccaaattcctgtactgtaaagactaaaaggcgtttgctctgagactgacaaggcggaaacttccatgtgtctcctgccaggctctgtccccctacgccatcccgacacgtccccgttcccccgaaacctggctcagtgcaatactcccattgccatggggtccttcaccatggtactgtctccacagccctcagtccccaccccaggagaggcgcctgccacctcctcctcatctccggtggttcaatcgctccgcctgtccccaacccagtcccatttttatggccaaactgattctgaaacaaaatgaaactgcaaacctcgtgtgtcttaactccccccagggatgccactccattcctccgccccgtggtctggtgcgtgacaatccaaagcgccgagacgagggtgctgtgtccctcaaacccagagtggtgggcgcctctgaaaccatacagccactcctggccccaaacactggtttgcatcccaggttcctcgcccacctacccccgccacaccccgtctttttagagatctctctaataaatcgggtaataagc

SEQ ID NO: 22211 - DNA, 3326 bp, Homo sapiens
atggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctacttttggcgcctctggggtccccatgcacccacctggccctggagaagggagggacgggccgcgtgcctgtgcccctacccaccgcacgtcgtcaccccttttcctgggactggtttgtgcgcgtcctggtctccggatggtacggggggcctgggggccatgtcgtgctgtgtgtctgtgtcctgatgccctgccaggtgggcagcagagaagggagaagggtcctcggtcctgcccctgccccggcaccccccaccttctgcttggcagtcagctgtccccacctgctccccgccacctccctccgcctctcccacccgaccacgggggtggccgcctcatccgctgtcctctgttttccttcctcctccggcccacccggcccgccccgtccagttcacggatgggaggtactggatttactctccccgccatcgccgactgcgggccgtgacgctgagcgcctcggggactgtaagtgaccgcagccggccaccctggggagaaggggcagtgcccctcgggcagcagggagccgcaggtccccggccggaagctcagtgtctgacgtcagttgttttccagaagggctttgggtaaatcacggctgcaattgaggtcagccacgctggccccggaccaggcgctgggctgcatgcgtcactgggaatgtcattcggtcccacgtcgaaccgggcgctccatagggcagcaccatcaccaggtgcacagctgaggcccagggtctgcttcggaccccggccagaccccagcgagcccctctctgcccctggacccagccctctcgtgtcagggtgtcttgggtggacgcttctcactcgtgcagacctggctgcccgtggccccgctggctgcacaggggaggttgcacaggtcagcagagtggctgcagggccgggctctgaaccgcagggccatggagacggggaggagatggtctctccacacccacctcacagatggaggcgctgaggcctcggctcccctgggagcctgggagaccacacggtttagtcaaaatccagatccccaagctctcaaggaggtccccctgggacgccacatgggccccacgtagctgtgagatcctcagggcctgctgttgtcattatgaccaataagcaaggggcccagagagcctaagagacctgcccagcaccgcacagccagaacggggcgcagacccaaagcaggagtgtcccctcgagacaaagcctccgccgaggccgccgtgactccccgcccatcagcaaacctctccgagcacctctgtgtgccaggcactgtggagtgaccccaagaggtggagaccacttccccggctgctctaggcagctccgtcccacggagccagcgggaagccagccaccgcgaagccgtgccccgga

SEQ ID NO: 22212 - DNA, 2289 bp, Homo sapiens
ggcgcttgttgttcggcggcggcggtcgcagctcgggtccccctcgggcgcccccgccgccgtccgcgcgcggccatggagctggaggtaccggacgaggcggagagcgctgaggcgggggccgtgccctcggaggcggcgtgggcggcagagagcggggcggcggcaggtttggctcagaagaaggcggccccaacagaggttctgtccatgacggcacagccgggccctggccatgggaagaagttgggccatcgaggtgtggacgcatccggcgaaaccacctacaagaagaccacctcctccaccctgaagggtgccatccagctgggcatcggctacaccgtgggccacctgagctccaagcccgaacgcgacgtgctcatgcaggacttctacgtggtggagagcatcttcttccccagcgaaggcagcaacctcacccccgcccaccacttccaggacttccgcttcaagacctatgcacctgtcgccttccgctacttccgggagctctttgggatccggccagatgattacttgtactccctgtgcaatgagccgctgatcgagctgtccaacccgggcgccagtggctccctcttctacgtcaccagcgacgacgagttcatcatcaagaccgtcatgcacaaggaggccgagttcctgcagaagctgctccctggctactacatgaacctcaaccagaacccgcggacgctgctgcccaagttctatgggctgtactgcgtgcagtcggggggcaagaacatccgcgtcgtggtcatgaacaacatcctgccccgcgtggtcaagatgcacctcaagttcgacctcaagggctccacctacaagcggcgcgccagcaagaaggagaaggagaagagcttccccacctacaaggacctggacttcatgcaggacatgcccgaggggctcctgctggacgccgacaccttcagcgccctggtcaagacgctgcagcgggactgcctggtcctggaaagtttcaagatcatggactacagcctgctgctgggcgtgcacaacatcgaccagcacgagcgcgagcggcaggcgcagggcgcccagagcacctcagatgagaagcggcctgtgggccagaaggcgctctactccacggccatggagtccatccagggtggcgccgcgcgcggggaggccatcgaatcggatgacacgatgggcgggatccccgctgtgaacggccgcggggagcggctgctgctgcacattggcatcatcgacatcctgcagtcctacaggttcatcaagaaactggagcacacctggaaggccctcgtccacgatggggacacggtgtccgtccaccgccccagcttctatgccgagcgctttttcaagttcatgagcaacacggtctttcggaagaactcctccctgaagtcctcgccctccaagaaggggcgcggcggagccttgctagctgtgaaaccgctggggcccaccgctgccttctcggccagccagatccctagcgagcgggaggaggcccagtacgacctgcggggggcccgcagctaccccacgctggaggacgaaggccggcccgacctcctgccctgcacgccaccttctttcgaagaagccactacagcctccattgccacgactctgtcatccacatccctctccattcctgagcggtccccctcggagacgtcggagcagccgcggtacaggcggcgcacacagtcgtctggacaggatggcaggccgcaggaggagccacccgcggaagaggatctgcagcagattacagtgcaggtggagcctgcgtgcagcgtggagattgtggtccccaaagaggaggacgcaggggtggaggcttccccggccggtgcctctgctgctgttgaagtagaaactgccagccaggcctcagacgaggagggcgcacctgccagccaggcctcggacgaggaggacgcgcccgccaccgacatctacttttaatttctatgcagcccccgacccagagccgagctccacttctgctccggctgcccccgaaggcgctgcccaccccgctgaggcccagagctcgggagatgcccgcctcgccgccccaccggacctcgtcctccccctgcacggatgccgacggccgggcccctccccgacaagcctcccagggccccggcaccccggtcggcagcctgcccctgtgagacccaccctcccgagcggccaatcgcatttgagtccttatttggcacagagacggaagcacgtgtgtgccgtttt

SEQ ID NO: 22213 - DNA, 1104 bp, Homo sapiens
gtttaggggtgggatcgggtcgggatccggaccagccaaggaagggtccaggtgccgcggatcttgagaaggaggcgtggcctggcgctgggattggcgccggatgcaccccgggttgtggagtttggggatcctcatccggcgccctctccccttccaggagtgcacagtctgcgggtggaccggggaaagaagacgtacttcatcgtcatgcagagcgtcttctaccccgccggccgcatctccgagaggtatgacatcaaaggctgcgaggtgagccgctgggtggatcccgcccctgagggcagcccccttgttctggtgctgaaggacctcaactttcagggcaagaccatcaacctggggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaa

SEQ ID NO: 22214 - DNA, 2198 bp, Homo sapiens
gcggcggggaatgcggccaaagcccgggaagctgctgcgggggcgatggctgcgccgagcccggggccccgcgaggtcctggccccctcccctgaggctggatgcagagcagtcacctccagccggcgggggcttctctggcgcctccgagacaagcagtctcgcctgggcctgtttgagatcagcccggggcatgaactgcatgggatgacgtgcatgatgcaggcagggctgtgggctgccacccaggtctccatggaccacccacccacggggccgccctcccgggacgatttctcggaggtcctaacccaggttcacgagggcttcgagctgggcacgctggccggccccgcctttgcctggctgcgccgctccctgggcctggcggaggaggactatcaggctgccctgggccccggcggcccctacctgcagttcctcagcacctccaagagcaaggccagcttcttcctgtcccacgaccagcgcttcttcctgaagacccaggggcgccgagaggtgcaggctctgctcgcccacctgccccgctacgtgcagcacctgcagcggcacccgcactcgctgctggcgcggttgctgggagtgcacagtctgcgggtggaccggggaaagaagacgtacttcatcgtcatgcagagcgtcttctaccccgccggccgcatctccgagaggtatgacatcaaaggctgcgaggtgagccgctgggtggatcccgcccctgagggcagcccccttgttctggtgctgaaggacctcaactttcagggcaagaccatcaacctggggccccagcggagctggttcctccgccagatggaactggataccaccttcctccgggagctcaacgtgctggattacagcctcctgatagccttccaacgtctccacgaggatgagaggggcccgggcagcagcctcatcttccgcacggccaggtctgtgcaaggggcacagagcccggaagagtcgagagcccaaaaccgccggctgctgcccgacgcccccaacgccctacacatcctggacgggcccgagcagcgctatttcctgggcgtcgtggatctcgccacagtctacgggctccgcaagcggctggagcacctgtggaagacactgcgctacccaggccggaccttctccactgtcagcccggctcgctacgcccgtcgcctctgccagtgggtggaggcgcacacggagtgacgggcgcccggccccactctccggatctggacgatgggctcacgccaggaacgccggttcccccgggcccgggcatctcgcctgcgcttcctcctgatggtcgccagagggcagcatcccctaactaataccgtaaccgcgcagtcccgtttgacggtggtgccgtgcccagcatcgtgccaaggactcccctactttagctcatttaatcctcaaaaaatgctattattctctttttacagaccatgaaatggaggctcagggggtgaagggactgatcaagatcattcagcaataaatgctggaaccaggactcaaccatggcttttggattccggagcctgtattcttaaccaccagctcctgcagcttggtcctcatgatctgggcaaggggggaggctgaaggctgcagccctcttgtcatccagatggggaaactgaggcccagagactttaaggggcgtaagcacgggtaagtggcaaggtcggccctgagtacccaggcctcccggccccctgctcctggcctgatactctagggatgcaggtgggagaagcaggggtcctgggggctgcctggagctctgggaggcattctgaacggggtctactactgatctcaggtgagctctgccctcctctgaaagtcacttttctcatcagttaaatgggggcaagggtccgtggtccgaccaaggtcttggcttcacagacatcaccaggagcctgcatgcccctgatcactccttctccttcctccaggaaactccagcctggcctctgaccccagttcaatccgaccatgcccaagcccaagcgggcctttcctccagaactgctccggggcctggctgtgtgactggagcaaggtgctaaacctctctgtgcctcgctggtctaatctgtaaaatgaaggaatggaaacagacctcattaactcattaaatatttgttgagcacctgcca

SEQ ID NO: 22215 - DNA, 2655 bp, Homo sapiens
ggaagctggagccacctgcggctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttg

SEQ ID NO: 22216 - DNA, 1736 bp, Homo sapiens
atggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgtt

SEQ ID NO: 22217 - DNA, 2669 bp, Homo sapiens
ccatcctgcagctctgagagggacagacggtgctcagcctgtgtcctggggcaaagctggattcattttcctccctggcgatcttctggggcccacagctggtgatatggaggcactgacaccctggtctcggcgcttgttttagaagaggcagaacagtgataaagacaaggatctaaatgggcaaggacgccctgccctcactgggctcactggcagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagagacatcattgaattttttcaactgtatcagtagcacagtatttttgtatgaaaagtgggagacttctgaacagtaattcatttaattgcaaagcattttgaaataaaaaaaatcaaacttaaaa

SEQ ID NO: 22218 - DNA, 2194 bp, Homo sapiens
ggagcccggaagctggagccacctgcggccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgttcccacattcacctcatcctgctctttagaaaaagcagtctttgtgcttgtggctgaacgcatcaccctggactctgctagtgtcttctgaggacactgatgacactgattaatgatacagacctttgcaggacctgatgagtgacccttctggagctggccaggtcctctgcagcaggcaagaccaatcaatcactgaacctgcctcatggcaccagagtgaacagggcaggcaggtagtaggcccagctggggaaatgggagagttcctgtccccctccacatatccctacatgaaatatgggaaagttgctgctattgattcagggtctgtcttggaggcagaggacccttggtggatagttggtcagtgcctggaaaacctgtcccagtttatcaggaacgcaggcctggggagcccccagtggcggggacagggccagatttcatgttgaccctggggatgctgtgaatttctcctgcaggagag

SEQ ID NO: 22219 - DNA, 1015 bp, Homo sapiens
gggccggtcactccgcgcaagtttgggttcctgttttagaactgccacctaagcccctcttatttcatctttcctgtggtggaaacccctgcccccaccggagtgtgaggttgactttttggaaagagagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggac

SEQ ID NO: 22220 - DNA, 609 bp, Homo sapiens
ccttcatccccccttcctcgcccctccacagacccagggcatttggtggacacttttgcttgcagttaggtcaagtggaggtatggaagaacatggaaatccatggaggaggaccctatctgtcttcttccccctgccgcatcccagggctgtggcttgtcatgtggcacttgcttgggctggatccagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagg

SEQ ID NO: 22221 - DNA, 460 bp, Homo sapiens
atttggtggacacttttgcttgcagttaggtcaagtggagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagg

SEQ ID NO: 22222 - DNA, 1963 bp, Homo sapiens
ctgcgaccaagcccaggtttagcgaaacctacagctccactagttcccctacctccgcaggtgccaagcgggttaggtggggagtagccacagggcggagcttagtcggctccgcccccaacccgcgcttttctcattggcccactgaactcgagactcgtgacgccttaagcgtgcgcccagcgtgtgaagggggcgtggcacgctgagaaggagcagacaagatggcgacgtccgtggggcaccgatgtctgggattactgcacggggtcgcgccgtggcggagcagcctccatccctgtgagatcactgccctgagccaatccctacagcccttacggaagctgccttttagagcctttcgcacagatgccagaaaaatccacactgcccctgcccgaaccatgttcctgctgcgtcccctgcccattctgttggtgacaggcggcgggtatgcagggtaccggcagtatgagaagtacagggagcgagagctggagaagctgggattggagattccacccaaacttgctggtcactgggaggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcttcgtgacgcacaccaatagagagggcgtccccatgcgtaagggcgagcacctgggcgagttcaacctgggctccaccatcgtgctcatcttcgaggcccccaaggacttcaatttccagctgaaaacaggacagaaaatccgctttggggaagccctgggctcgctctagagtctctttcctgattatggctgctaagggatcttttccaaacagagtgagggtcttttcaagagggaggcccatgaggccatccaggtaagggcctgcctcagcgtggttgggagtctgaccaggtaggacttgaatgattcggctaccacctgttccagaggtgcagacaagaggtggcgagagcccccatcatgcccctcaacctatcccgttccttctgcctacaaataaaaagtgcaggctggaatgatctcagtcacatttggatctttttaaacactgtatagacggaagagcctgcattcctgaccgaaccttcagttggtctcggttgtcgttttttcttgctgctcctccccccatcacctgagctgttttctgttggccccttttgttttttggccttaacgctcctgctgcacagggtgaggtgcctccttggcacagactgtggatgcctctcccccagcagagccacacagccttcgtgacaactgctttccgtt

SEQ ID NO: 22223 - DNA, 722 bp, Homo sapiens
aagtggggcctgaaagccctggcagcagtggctggtcccctccctgtcatggcttactggaccgggcagccctagggccttgccccctactgcctccccaggccagctgaggaagaggatgagcagtgcaggctggctcagccctgggtagcagggacagagcaggtggccaggactggggacagtgggctttagtgcaggggcttttgcactggactgcaagccctgagcaggtgacctgagcaggtgtgtgaccagtgcctgtctgtctgcaatagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgcca

SEQ ID NO: 22224 - DNA, 1349 bp, Homo sapiens
ttggccaacaagcgtttctccctcttccctgttctccccacttccccacttcatcccccttcatccccccttcctcgcccctccacagacccagggcatttggtggacacttttgcttgcagttaggtcaagtggagccctgaccctctattctgcaccctgtgagccaccgagactgaaccaaacccaggaagcggcgccaccaaccagcctcgcagaggcagaggccctggagcagtgacagcacaggagatctgctggctcgggggaaggggaggaaagaggaaaacaaagggagtgatcgagtgagcctcgccccgccctccctgcgccggcccatgatgtgtcagtcagaggcgcggcaaggaccagagctccgcgcggcgaaatggttgcacttcccccagctggccctgaggcggaggctggggcagctgagctgcatgtccagacccgctctgaaactgcgctcctggcccttgaccgtcctctactacctcctgcccttcggcgccctcagaccgctcagccgggtgggatggaggcccgtaagcagggtggctttgtacaagtcagtgccaacgcgcttgctgtcacgggcctggggtcgcctcaatcaggtggagctgccacactggctgcgcaggcccgtctacagcctgtacatctggacgtttggggtgaacatgaaagaggccgctgtggaggacctgcatcactaccgcaacctcagcgagttcttccggcgcaagctgaagccgcaggcccggcctgtctgtggcctgcacagcgtgattagcccatcggatggaaggatcctcaactttgggcaggtgaagaactgtgaggtggagcaggtaaagggggtcacctactccctggagtcgttcctgggcccgcgtatgtgcacagaggacctgcccttcccaccagccgcgtcgtgtgactccttcaagaaccagctggtcacccgggaagggaatgagctctatcactgtgtcatctacctggcccctggggactaccactgcttccactcccccaccgactggactgtgtcccaccggcgccacttcccaggctccctgatgtcagtgaaccctggcatggctcgctggatcaaagagctcttctgccataacgagcgggtggtcctgacgggggactggaaacatggcttcttctcactgacagctgtgggggccaccaacgtgggctccattcgcatctactttgaccgggacctgcacacaaacagcccaaggcacagcaagggctcctacaatgacttcagcgtggttgggagtctgaccaggtaggacttgaatgattcggctaccacctgttcc

SEQ ID NO: 22225 - DNA, 2360 bp, Homo sapiens
cagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagcct

SEQ ID NO: 22226 - DNA, 5177 bp, Homo sapiens
agccaggggccccggctacccttctccggctcgctattcctctgaagtcctgtggacttggagtctgaaaattcctcgagtggtagagatgcctcagctaggatgacagcgtggggacggccggcggcgtcccctgccccaggccgcggtggcggcgccgcgaccccgccctctcgcgcctgtccttccctctgctcccagcctttgctgggcgccagacccggctttgccgtccggctattagcctactgtggctagtcacccccggggtcccggccttctcgggctggggccgccgccaccgcggcaggacggggaggcgggccatggcgtcctgcgtggggagccggaccctaagcaaggatgatgtgaactacaaaatgcatttccggatgatcaacgagcagcaagtggaggacatcaccattgacttcttctaccggccgcataccatcaccctgctcagcttcaccatcgtcagcctcatgtacttcgcctttaccagggatgactctgttccagaagacaacatctggagaggcatcctctctgttattttcttctttcttatcatcagtgtgttagctttccccaatggtccgttcactcgacctcatccagccttatggcgaatggtttttggactcagtgtgctctacttcctgttcctggtattcctactcttcctgaatttcgagcaggttaaatctctaatgtattggctagatccaaatcttcgatacgccacaagggaagcagatgtcatggagtatgctgtgaactgccatgtgatcacctgggagaggattatcagccactttgatatttttgcatttggacatttctggggctgggccatgaaggccttgctgatccgtagttacggtctctgctggacaatcagtattacctgggagctgactgagctcttcttcatgcatctcctccccaattttgccgagtgctggtgggatcaagtcattctggacatcctgttgtgcaatggcggtggcatttggctgggcatggtcgtttgccggtttttagagatgaggacttaccactgggcaagcttcaaggacattcataccaccaccgggaagatcaagagagctgttctgcagttcactcctgctagctggacctatgttcgatggtttgaccccaaatcttcttttcagagagtagctggagtgtaccttttcatgatcatctggcagctgactgagttgaataccttcttcttgaagcatatctttgtgttccaagccagtcatccattaagttggggtagaattctctttattggtggcatcacagctcccacagtgagacagtactacgcttacctcaccgacacacagtgcaagcgcgtaggaacacaatgctgggtgtttggggtcattggtttcctggaggccattgtttgcataaaatttggacaagatctcttctctaagacccaaatactctatgttgtgctttggcttctttgcgtggctttcaccactttcctctgtctgtacggcatgatttggtatgcagaacactatggtcaccgagaaaagacctactcggagtgtgaagatggcacctacagtccagagatctcctggcatcacaggaaagggacaaaaggttctgaagacagcccacccaagcatgcaggcaacaacgaaagccattcttccaggagaaggaatcggcattccaagtcaaaagtcaccaatggcgttggaaagaaatgaaaaaccctggttaatcaaagatgttccagagtgcctagaactgagagggaaatggaactcatttggaactccccgtgaggaggtcgaggcgcacagggcaagcaggaagaggcgagggcacttgggggtcattatttgagatcgtaagtcttgtttcccacagacctggccgcgtcaggcagatcatcgcctggggggcctttgccaacgtggggtctcttctaacttcagcacttgacatgcggtcaccggtggcagcgcggtgtgttgaagggaaacggtagctattcattcacagttgccaagagcagctccgcgcctgctggatcgtggatgcagcgtaaacatcttccttcagacgaggcattaaccccatggttaatggactggtcaccagtttttattttatttttatgaatctacctttccattgattgatttaagttcaggccacttttctgtcttttatttggttactgttgttatttgtttttaagttaggatgctttttaacagcctttagaagccgctgctgaaattgatactgggggaagggttccccttccttctagagcagaaaagggagagaggtgttgtattcctgtttggtaacctcagtctcctgtaagacctcctaccacatggcgagtatacaccaatcaggagagggtagctgcctgcataggagcctcgcttccgattattcccttcccaatattattcatccagacttagccacagtgcacaaaagcaaacctgctagagaggcagtgaacaccacagcttctccccagctaggtgccttttacatcgggtttgttctccttccatggtgtgttgctgacattgtcactgagtcccatgtgaggtgctggtgagtattacctttcatctgtgccatgctctagaaccttgaccttgatagttcaccacctctgatggatccctgttttaaataaaaacgattcactttaaagcctatcaaaggtctgtctgtaaaatgctcattttcttgcatcttactggtatcttctattgattgtaagcagtctgtgtttttcaagtgactttaggataatatatatgtgttttacatagtgagaagaaaaaagaaaagatgtgtattttaaagggcttacagacatatatgtcctacttcttagactacccaagtgaccaacaggaatgaacaacatagtcattgttttttcctgtggtaatggtttccaagttggacttttttttcctctaacaagaggccagtacccagttgattagcttacagatatcaactcactgaaagtaatcttttgttccctcatttcacacagcacaaaggttcgttctgatgtttcttcttctttaaggaaatctttagccatagaagtgtcactttttttttttctgcaaaagaattccaagatgaacgggttgaatgaatcatgccagccagggtcacatcctgtcctcagggggcccagtgctcaatagtagattctgcgggagtggagaagcgtcagtggcagctccgctcacttggtgagtgagggatttggctgtgatgagcctcagctccgagctctcaaatgtcctccagccagcatctgcctgcttcccacaaaaggatagaagagaggcaaagtgcgtgtttcataaaacctgcctgcacttttataacccatcaaagaggccatttttaaacacaggtacaatttaaacatgatctttctttgcaaataaatatgttttgtttcatcctgtgttctgcttttctaagcatgacatacttgtgcccattggagaagacacctgtctcttctttctcacaccggtggtgcctcactgagtgtttccgggttcattttccgggagcactgggcctgacactttcacactcttctgactttcgccttgttgcaactgatggagcatgtgtgcttcctctgaggccagcctacaggaggcagctgtttcgcaggtggtgaattcgactttactgtggcattgtgaagagcagggtgcacaggagatgattttttctccatggctttgtaagaaacagccaggaaagttctcagatactttccatgccctttctttgagttgaaactttctatttcccttcagtcagagctctttactatagtagttacaaaaccagtgctttccatggctggccagaaccacagctgctattccttttagaagccatactgctgggtttggcctacttttttcaccgtttctatggaaataaacctcacattgatggaaatagaatgcgtgtttcagaatcatcattcaatatctgaaatgatttgattgtaaattatctcatggtccctgtttgcaaaccaccctcttaagagagaacattgttttggacctaaagcttgaagaacggtttatgtatttttctccttaagtagcattgcattgagtgttaggttcttttccctttttttcattcttggtcttcccaaagcttcttcccacatttcgtttgtgtctgtttccaccattcatagaaaccttggaaccactctcacagcaatgctaggatgtttcatggacctgttaagcattttgatgatacaagacatcctatcaatgccagtcttattttcgctaggactctgcttccacagtaagctcctaaggtgctcacccaacccaggagaaaacaaaattcattaccaaatacaacaggttcagccttcttggtcttccctcagaagccaccgtgtagcaccctggaatgatgcctctttatgccaaggcccaccctttggaattgggagggttttgggtagaatcctgcacttacagaggcccttggggtcattgagaagtggaggaggttggacacagaaggggaggctaaacacaaggtggggaagaaaaaatgtaaccattggcagccagactgaagctagccctttaaaatacggggttggggggttaacatccgctctttggaatgtgctcagtgactgctgcagagttcctgggccaccctaatgtttaccaggtgggcgttgtttatatggttcttattgttatgacaactagaaatcccacagtagactagacagtgctccctaccatttcccatttataggattgaaatcaagatgtaaggagagctggccgggcgcagggctcacgcctgtaatcccagcactttgggaggctgaggtgggtggatcgcctgaggtcaggagtttgagaccagcctgaccaatatggtgaaaccctgtctctgctgaaaatacttaaattagccgggcatggtggcaggcacctgtagtcccagctactcgggagacagagacagaagaaatgcttgaacccaggaggtggaggttccagtgagccgagatcacgccaccgcactctctaacctgggcgacagagcgagactatctc

SEQ ID NO: 22227 - DNA, 2445 bp, Homo sapiens
caatgcaccgcacaccctttactggccggccccgcgctgctctcctaagaccccgcgggccagcgccgcgaccccttcccagcgctcctcgcgctgtgtgcggcgcgtcctctcgccggtgacccggtgtgcgtggggtcgaggcgccgggcggagtggctccgggccgaaacgccatgcggaggggcgagcgcagggacgccggaggtccgcggcccgagtccccggtgcccgcgggcagggcctcgctggaggagccgcctgacgggccgtctgccggccaagccaccgggccgggcgagggccgccgcagcaccgagtccgaggtctacgacgacggcaccaacaccttcttctggcgagcccacaccttaaccgtgctcttcatcctcacctgtacgcttggctatgtgacgctgctggaggaaacacctcaggacacggcctacaacaccaagagaggtattgtggccagtattttggttttcttatgttttggagtcacacaagctaaagacgggccattttccagacctcatccagcttactggaggttttggctctgcgtgagtgtggtctacgagctgtttctcatctttatactcttccagactgtccaggacggccggcagtttctaaagtatgttgaccccaagctgggagtcccactgccagagagagactacgggggaaactgcctcatctacgacccagacaatgagactgacccctttcacaacatctgggacaagttggatggctttgttcccgcgcactttcttggctggtacctgaagaccctgatgatccgagactggtggatgtgcatgatcatcagcgtgatgttcgagttcctggagtacagcctggagcaccagctgcccaacttcagcgagtgctggtgggatcactggatcatggacgtgctcgtctgcaacgggctgggcatctactgcggcatgaagacccttgagtggctgtccctgaagacgtacaagtggcagggcctctggaacattccgacctacaagggcaagatgaagaggatcgccttccagttcacgccgtacagctgggttcgcttcgagtggaagccggcctccagcctgcgtcgctggctggccgtgtgcggcatcatcctggtgttcctgttggcagaactgaacacgttctacctgaagtttgtgctgtggatgcccccggagcactacctggtcctcctgcggctcgtcttcttcgtgaacgtgggtggcgtggccatgcgtgagatctacgacttcatggatgacccgaagccccacaagaagctgggcccgcaggcctggctggtggcggccatcacggccacggagctgctcatcgtggtgaagtacgacccccacacgctcaccctgtccctgcccttctacatctcccagtgctggaccctcggctccgtcctggcgctcacctggaccgtctggcgcttcttcctgcgggacatcacattgaggtacaaggagacccggtggcagaagtggcagaacaaggatgaccagggcagcaccgtcggcaacggggaccagcacccactggggctggacgaagacctgctggggcctggggtggccgagggcgagggagcaccaactccaaactgacctgggccgtggctgcctcgtgagcctcccagagcccaggcctccgtggcctcctcctgtgtgagtcccaccaggagccacgtgcccggccttgccctcaaggttttttgcttttctcctgtgcacctggcgaggctgaaggcgaggggtggaggaggccccagcacagcctcatctccatgtgtacacgtgtgtacgtgtgtatgcgtgtgtgtacgcgtgtgtacgcgcgtgtgtacacatgcgtggccgcctgtggtgtgcacgtgtgctctgggctccgaggcttctccagagctgggagctggctggcgtggcaagggcatgctctggggcagtgtgtccctcaggaaccagggtcctccctcccctttctgcctggtcagccccgtggcctctggcccaccaagctccctgtcacccagccatggtgtggtccaggcagggacatctcggtaccctttctgcactccgtgggccctgggtgcgctgaggcctggaggcgtctacactggctccacatccacttcccccgcagctcgtgtgggcgctcgtccacaaacactccgtggctgagaggcagcggatccaggcagcgatgctgagccacctcctccgagccttcctttcacacagaccaccccggaggacacgtggatgatggggtcagagatcactgagctgcccctcaagggggcctggaacccgggtgctggggtcatgctgcctccgtggctccaaggtgagggtcatcttcacgagcaaagagaaccaataaagtgacaacgaacgtctgaggcttcca

SEQ ID NO: 22228 - DNA, 4458 bp, Homo sapiens
gcagcggcggcagccagaacaggagcagcgatagctcgggtttccggaacaggagccggggcagcggcggcagctcagtgctgggcacctgtgcggagcaggagtagcaggaccacggggtggggtcggcgccagccactctgagccagagaaggaaggggcatctcccagattccactgctgggaataatctccaggggaggtggcgctgaactgggaatactggtgggggtgaacatgtgcaggaacagctagaggcctcggggcaggaaaacatttggttcacgtgtaaacaggcaaggaaagctgtctgggaccatggcagcctcccgcctggactttggggaggtggaaactttcctggacaggcacccagagttgtttgaagattacttgatgcggaaggggaagcaggagatggttgaaaagtggctgcagaggcacagtcagggtcagggggctttaggtccaaggccctctttggctggtaccagcagcttggctcacagcacctgcagaggtggcagcagcgttggtggtggcactggaccaaatggctctgcccacagccagccccttcccggtggcggggactgtggtggggttcccttgagtcccagctgggccggtggcagcaggggcgatgggaacctgcagcggagagcttctcagaaagagctaaggaagagttttgcccgctccaaggccatccacgtgaacaggacctacgatgaacaggtgacctcccgggctcaggaacccctgagtagtgtacgacggagggcacttctccggaaggcaagctccctgccccccaccacagcccatattctcagtgcgctgctggaatcgagagtgaatctgcctcggtatccccctacagccatcgactacaagtgccatctgaaaaagcataatgagcgtcagttctttctggaattggtcaaagatatctccaatgaccttgacctcaccagcctgagctacaagattctcatctttgtctgccttatggtggatgctgaccgctgctctcttttcctggtggaaggggcagctgctggcaagaagaccttggtctccaaattctttgatgtgcatgcaggaacacctctgctgccttgcagcagcacagagaactcaaatgaggtgcaggtcccctggggcaaaggtatcattggctatgtcggggagcatggagaaacggtcaacattcctgatgcctaccaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaagcatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcgttttgtatagggcttttctgtttgttacaagccaaacactgcctgtctttgcttcctgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatctagaaactatagttcacaggacagagcagagccatggagactaagcattgactaccttgagttctcctagtgaggagttctggtataaaatttaagattactaccagtaaccaacttaaagcaaactataggggtccctaattttggatttttccttaagtgtaagaaacaatgcttcaaatgttaagaaataacagtctgggcaaagaacgcatattctataggaagccaggtttacaataggtaagaataaactgtattaagtagatgtaatgactagaaagctgctttgctccctatattgagaaattgtggacatggtatgtgttatccaaagaacattgggctagaagatagatttctatccttagctttggcattattgactggattgacttgaacaagtcacttaacttctacaagcttgtttccttatttgtcaaattagattacactaggaaacgattctcgaacatgttttaaccttacaactctttgttcaaataaatctttcaatgaatccccaacatataaaacgtcaaaaa

SEQ ID NO: 22229 - DNA, 3489 bp, Homo sapiens
cgcttgcagcccagggcgtgaggtgctctttctggatcgccagcctcgaagttgaggcgtggactctggccaggtggctgttccagagcaacatgggagatgctgaagcaggcaagaagacctttattcagaaatgtgctcagtgccacacagtggaaaaaggtgaaaatcacaagactggtccaaatctctggggcctctttggctgaaaaacaggaaaagcaccaggattttcttatacagaggcaaacaaaaacaaaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaagcatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcgttttgtatagggcttttctgtttgttacaagccaaacactgcctgtctttgcttcctgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatctagaaactatagttcacaggacagagcagagccatggagactaagcattgactaccttgagttctcctagtgaggagttctggtataaaatttaagattactaccagtaaccaacttaaagcaaactataggggtccctaattttggatttttccttaagtgtaagaaacaatgcttcaaatgttaagaaataacagtctgggcaaagaacgcatattctataggaagccaggtttacaataggtaagaataaactgtattaagtagatgtaatgactagaaagctgctttgctccctatattgagaaattgtggacatggtatgtgttatccaaagaacattgggctagaagatagatttctatccttagctttggcattattgactggattgacttgaacaagtcacttaacttctacaagcttgtttccttatttgtcaaattagattacactaggaaacgattctcgaacatgttttaaccttacaactctttgttcaaataaatctttcaatgaatccccaacatataaaacgtcaaaaa

SEQ ID NO: 22230 - DNA, 1781 bp, Homo sapiens
tggaaagatgttacttcatctcccaggtttgctcactgcaaatacaatcctgagaactgaactagggccttaaagtcctgacatgcatggcttggttttgtggattgcctctctcaacaggtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaagcatgcctgggctttcaccttgaagcatggtcagcagca

SEQ ID NO: 22231 - DNA, 2102 bp, Homo sapiens
aaaagtccactgtgtgttgggaatagattatgaagggctttgagtgtaggccctgtaagcaataggaagccatggaacagccagaaaggttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccagctcagaaagacctaacatctcaaggatgcactgggaagcatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctg

SEQ ID NO: 22232 - DNA, 2449 bp, Homo sapiens
gcgcgcgtccggctgcgcttgcagcccagggcgtgaggtgctctttctggatcgccagcctcgaagttgaggcgtggactctggccaggtggctgttccagagcaacatgggagatgctgaagcaggcaagaagacctttattcagaaatgtgctcagtgccacacagtggaaaaaggtgaaaatcacaagactggtccaaatctctggggcctctttggctgaaaaacaggaaaagcaccaggattttcttatacagaggcaaacaaaaacaaaggatcgacgattcaatgatgaaatcgacaagctaactggatacaagacaaaatcattattgtgcatgcctatccgaagcagtgatggtgagattattggtgtggcccaagcgataaataagattcctgaaggagctccatttactgaagatgatgaaaaagttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccagctcagaaagacctaacatctcaaggatgcactgggaagcatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctg

SEQ ID NO: 22233 - DNA, 1869 bp, Homo sapiens
caagaaatgtagagggagaagagtgctggaagatgagtcaagaaaagtccactgtgtgttgggaatagattatgaagggctttgagtgtaggccctgtaagcaataggaagccatggaacagccagaaaggttatgcagatgtatcttccattttgtggaatcgccatatctaacgctcagctctttgctgcctcaaggaaagaatatgaaagaagcagagctttgctagaggtggttaatgacctctttgaagaacagactgacctggagaaaattgtcaagaaaataatgcatcgggcccaaactctgctgaaatgtgaacgctgttctgttttactcctagaggacatcgaatcaccagtggtgaaatttaccaaatcctttgaattgatgtccccaaagtgcagtgctgatgctgagaacagtttcaaagaaagcatggagaaatcatcatactccgactggctaataaataacagcattgctgagctggttgcttcaacaggccttccagtgaacatcagtgatgcctaccaggatccgcgctttgatgcagaggcagaccagatatctggttttcacataagatctgttctttgtgtccctatttggaatagcaaccaccaaataattggagtggctcaagtgttaaacagacttgatgggaaaccttttgatgatgcagatcaacgactttttgaggcttttgtcatcttttgtggacttggcatcaacaacacaattatgtatgatcaagtgaagaagtcctgggccaagcagtctgtggctcttgatgtgctatcataccatgcaacatgttcaaaagctgaagttgacaagtttaaggcagccaacatccctctggtgtcagaacttgccatcgatgacattcattttgatgacttttctctcgacgttgatgccatgatcacagctgctctccggatgttcatggagctggggatggtacagaaatttaaaattgactatgagacactgtgtaggtggcttttgacagtgaggaaaaactatcggatggttctataccacaactggagacatgccttcaacgtgtgtcagctgatgttcgcgatgttaaccactgctgggtttcaagacattctgaccgaggtggaaattttagcggtgattgtgggatgcctgtgtcatgacctcgaccacaggggaaccaacaatgccttccaagctaagagtggctctgccctggcccaactctatggaacctctgctaccttggagcatcaccatttcaaccacgccgtgatgatccttcaaagtgagggtcacaatatctttgctaacctgtcctccaaggaatatagtgaccttatgcagcttttgaagcagtcaatattggcaacagacctcacgctgtactttgagaggagaactgaattctttgaacttgtcagtaaaggagaatacgattggaacatcaaaaaccatcgtgatatatttcgatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccag

SEQ ID NO: 22234 - DNA, 1204 bp, Homo sapiens
agtgctgccccttgttgaggaaaggaagatatcaatgttaatgacagcctgtgaccttggagccgtgaccaaaccgtgggagatctccagacaggtggcagaacttgtaaccagtgagttcttcgaacaaggagatcgggagagattagagctcaaactcactccttcagcaatttttgatcggaaccggaaggatgaactgcctcggttgcaactggagtggattgatagcatctgcatgcctttgtatcaggcactggtgaaggtcaacgtgaaactgaagccgatgctagattcagtagctacaaacagaagtaagtgggaagagctacaccaaaaacgactgctggcctcaactgcctcatcctcccctgccagtgttatggtagccaaggaagacaggaactaaacctccaggtcagctgcagctgcaaaatgactacagcctgaagggccattttcagtccagcaatgtcatccttttgttcttttagctcagaaagacctaacatctcaaggatgcactgggaagcatgcctgggctttcaccttgaagcatggtcagcagcagagagagcaacgggaaggacaaagaaagaggtggggcagggagcacaccccaggaccctcacttttccctaatgaacacgcatgggctgaaatgaaggctctgggtaggggactgttttggatccaaggacctgtggacagtcggcctacttactctgagctgagggaacactgaacagtaaaagcgtcattagcgctgcttcgttttgtatagggcttttctgtttgttacaagccaaacactgcctgtctttgcttcctgtccctgaatgcctttttgtgccagactgtcccaagaatcctaatttgtattccatagaggtattttatttttaatcctagagcttcttattgatggatcctttagaattgcctacctaaaaggtaaactatactatccttataaatactgatcaatcccagttctccccctaaaaatgaatacatagtaggactatagcaaatgtgtttgatgggtaattctagactgggactatggtacccttttccagagttttaaaattcaaccttcattacagacaaagttttctcccagaaggaatggattgatagattttgattaaagtaagggtggaaggaaatctgtagctggatttaccacaagtgacatcta

SEQ ID NO: 22235 - DNA, 1638 bp, Homo sapiens
atggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtgaatctgatcttcataagaactcagaagacttagtaaatgctgaagaaaaacatgatgagacacattcatag

SEQ ID NO: 22236 - DNA, 1991 bp, Homo sapiens
atgggcaaaaagataaacaaactattttgctttaattttctagttcagtgttttaggggtaaatcaaaaccatccaaatgtcagatcagaaagaaagttaaaaatcatatagaaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtgaatctgatcttcataagaactcagaagacttagtaaatgctgaagaaaaacatgatgagacacattcataggcccgaaacaccttaaagacttctgtcattttaaacatgagaggacaatgaaatcagcatgaaaacatcctaaattctcaactttccacaaagctatggctcttctttcaacatagaattggattgggccattttaattgactcctatacaaggaattaagaagaacataaattttgagctagtaactctggccaaataaatacactcaagtttttatcagagtttttggccagtgcttctgccatttttttccctccacaatttggccttcttcaatcaagccagataaatttttgagacaaaagtcagacagtttttaatttttcttgctttgaaccctgtcataatgactgtgcaatacatgtgcagaagatgaggtattttaaaatttacttccttgcactgtcttacacagagtgctataactataaatttttcaaggtcttaaataaaa

SEQ ID NO: 22237 - DNA, 2263 bp, Homo sapiens
ccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagcagct

SEQ ID NO: 22238 - DNA, 1608 bp, Homo sapiens
atggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaa

SEQ ID NO: 22239 - DNA, 2034 bp, Homo sapiens
ggagcttgaccagcatgtggaaggagagctctcatggctgcaataacttagggagttcctacctggatgacactggggtaggaagttttctgtttgttttgttctgtttcggagggtcccgtgcacttctcttgcctggatcaacgtgactcttggtggtttttgcacaccctgctctgtgggggagtgccccaacgtgcctgtcttatgtggcctctatggacacactgctcagctggcagagaacagggaagttttctcccagcacccaaaaagagaaagaggaaactactttttctttctgggctccttgcagcacaatagatcaggataagcttccacatttcctctctggagtttctggagtggtttccaggaagaagttaaaccttcacctttaaatggatgaccatgtcacaatcaggaagaaacatctccaaagacccatctttagactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtgaatctgatcttcataagaactcagaagacttagtaaatgctgaagaaaaacatgatgagacacattcataggcccgaaacaccttaaagacttctgtcattttaaacatgagag

SEQ ID NO: 22240 - DNA, 2000 bp, Homo sapiens
gaattctgatgtgcttcagtgcacagaacagtaacagatgagctgcttttggggagagcttgagtactcagtcggagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaagaagcaagaaccagttcacagaagtgtgagtttattcatcagtaaacacctttaagtaaaacctcgtgcatggtggcagctctaatttgaccaaaagacttggagattttgattatgcttgctggaaatctaccctgtcctgtgtgagacaggaaatctatttttgcagattgctcaataagcatcatgagccacataaataacagctgtaaactccttaattcaccgggctcaactgctaccgaacagattcatctagtggctacatcagcaccttgtgctttcagatatctgtttcaatggcattttgtggcatttgtctttaccgagtgccaataaattttctttgagca

SEQ ID NO: 22241 - DNA, 4885 bp, Homo sapiens
ggtgaggtggtgagcagtggatatatgcctgtcaaagtcaatagcaaatctgtcagagtcttccctcagctttgtacatcagcactgttttgatagataagagaggctactgtataagtgtgtaagatttgtaatggactgaggaatgcttgttctagctgctgaaactgactgtaactgtattgtcttaggagcatcatcatggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtgaatctgatcttcataagaactcagaagacttagtaaatgctgaagaaaaacatgatgagacacattcataggcccgaaacaccttaaagacttctgtcattttaaacatgagaggacaatgaaatcagcatgaaaacatcctaaattctcaactttccacaaagctatggctcttctttcaacatagaattggattgggccattttaattgactcctatacaaggaattaagaagaacataaattttgagctagtaactctggccaaataaatacactcaagtttttatcagagtttttggccagtgcttctgccatttttttccctccacaatttggccttcttcaatcaagccagataaatttttgagacaaaagtcagacagtttttaatttttcttgctttgaaccctgtcataatgactgtgcaatacatgtgcagaagatgaggtattttaaaatttacttccttgcactgtcttacacagagtgctataactataaatttttcaaggtcttaaataaaaggaagcaaaaacaaaattattgaaaaattttttttgttgtgctggggaatatactatttagattgtccttcttattttaaatgcatgggaacagaatgacaggtgggatgctgaggagctggttgaagcatcagagcaatgctacagtccaacaatggagcattagatccccagctaggtgacctgatgaacacctttgtaaactctcatactgggaaatggcagtgaaacctttttctgaacccgtggaccagcctgcgtccgtccccatggtttcaaagcacgaatgcattacctccatggttgtggttacaagcaagtcacatgctatctacagttcatgataacaagaccgtcaaccattgctggagacagacactagaatggaaaatgaaatttgccagcgggatgtttatcccatcagaatgtaacaaaatatattaccagccaagagataagagacaagaatgtgtgtgtgtgtgtgtgtgtgtgtgtgtgtgtgttcaaaaatgtctatgaaaatgaaaacccacacttttctgtacagataacattatttgatgtgacttttatattttactacacagaaacaaactgcagccctcagaggccctgcttccttgtcatgttttgcctgagcatgtgcaaagtctttcctttgcttaaagctgaaaaactacctttatgcattgttagctgacaagaaagatcaagcacaattagatgttgtaacttttcactgtacaagcattgcaatgattgtgagcttcagtgaatttatctttgtgaaaggtaaaaattggctggaaagaatcaggagtagccataaattaaatcatgcaaaggaggatccatgcatcctaacaagttttctgctgcatctgcttccttcctgggctccacaatgttaagcaatattttagaaaagggtacaattggaagcttttaagcctgagtggtgagattttataactcacaacttagatctcttttaatgtgtaagccatattctatatgcatatttattatgcatcattgtaatttaagatatatttggatgtaggctgtataaatgcttttaattgttctgtgaatagatccttagctttagtttcacctgaatcttgtgcaaaacacagctaaataattgaattgtattatagacattatgaggtaattgatcttttaaatgtaaggagtaagattgatctataataatgtgctggggaaaacatttatagatatgtacatcatggttactttttgtcctttcaaatggactttttatttctatttatggagagactgtaactactgcttttaatgtctttttaaagcaagctatttaccagcttgaaaatatcatgcatttaaaatagaatctatctggggagtctaattactattgttcctatttgagccagttgtctttcagtaaagctatagaatctctcaaagaagtaaatagaaatactacttcttaaatgtcataggaagcatatccactttgtttctattagtactttaagatctataagaccttattactaaaaagtagaggaatataaagaattcatcaatttctgtatatgggctttaacctaattttccaggttatgcgacttataaagcactgtgaccaaacttccagagacagtaaaaaaaaaaaaaagaaaaaaaagttttactccttcagaagtattgtcatgctactgctgtacttattttcctaatctctctctatctgctatactccctccttttctttctttttcttttaagcttttatatttattccttcctttgttttcctctctgtaagacagctactactgagcactaattagtagaaagtcagagtggaggttatctgtgcatgtctttctgcaaacattactgttgaggccatctgaagagagggattgataggttaggctgttgcaccgtgaatgtcctgctttgcatttttaacctcagctccccaacatatatatcttgcagtttatatgccttttcatttaaccgaaacctcttttatttaatttttaacataacaacctacaattcttgtgtttttattatgctgtatttttctgtgtttcttattacatgtgattgctaaataaatcatatttgagggaaaacattgtgaaacatttggtgttttatgcaattcaatttagtgaggcattgaaaagttggagaaattgggggaaacccaaaggagaccaacttaaaaattgatatgagtttggtaagaaagtgctttttgttccattaaataaatactgattgaattacttattattatacctattattcataagctcctggctggaagcatggtgcatatatgcatatggcaatatttcctctagaaatttcaagtcttataaaggagataatctacacagactgtaatttatacctaataactagaatgccacataaaaaagtaaccagttgcaaataaaatgcacctatgtatatttgaggaggtaaaaaactgcttctgtcttcagagctttcaggactaagtggtgcatcagttggcatttagtaaataaaaacaagtttataaacattgccta

SEQ ID NO: 22242 - DNA, 1659 bp, Homo sapiens
atggggtctagtgccacagagattgaagaattggaaaacaccacttttaagtatcttacaggagaacagactgaaaaaatgtggcagcgcctgaaaggaatactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtagtgttgtttatgaggccttactgccatctctctctgtcttcacttctcctctaagagtttggattacttcttctagatttcttcttctatag

SEQ ID NO: 22243 - DNA, 2116 bp, Homo sapiens
accacttttaagtatcttacaggagaacagactgaaaaaatgtggcagcgcctgaaaggaatagccatatgtgagtggaaagatcttgaattgttcctgctcttcttgacagaagaaaataaaaactaagatgcttggtgaagcagctggaaagaggtgatgttaacgtcgtcgacttaaagaagaatattgaatatgcggcatctgtgctggaagcagtttatatcgatgaaacaagaagacttctggatactgaagatgagctcagtgacattcagactgactcagtcccatctgaagtccgggactggttggcttctacctttacacggaaaatggggatgacaaaaaagaaacctgaggaaaaaccaaaatttcggagcattgtgcatgctgttcaagctggaatttttgtggaaagaatgtaccgaaaaacatatcatatggttggtttggcatatccagcagctgtcatcgtaacattaaaggatgttgataaatggtctttcgatgtatttgccctaaatgaagcaagtggagagcatagtctgaagtttatgatttatgaactgtttaccagatatgatcttatcaaccgtttcaagattcctgtttcttgcctaatcacctttgcagaagctttagaagttggttacagcaagtacaaaaatccatatcacaatttgattcatgcagctgatgtcactcaaactgtgcattacataatgcttcatacaggtatcatgcactggctcactgaactggaaattttagcaatggtctttgctgctgccattcatgattatgagcatacagggacaacaaacaactttcacattcagacaaggtcagatgttgccattttgtataatgatcgctctgtccttgagaatcaccacgtgagtgcagcttatcgacttatgcaagaagaagaaatgaatatcttgataaatttatccaaagatgactggagggatcttcggaacctagtgattgaaatggttttatctacagacatgtcaggtcacttccagcaaattaaaaatataagaaacagtttgcagcagcctgaagggattgacagagccaaaaccatgtccctgattctccacgcagcagacatcagccacccagccaaatcctggaagctgcattatcggtggaccatggccctaatggaggagtttttcctgcagggagataaagaagctgaattagggcttccattttccccactttgtgatcggaagtcaaccatggtggcccagtcacaaataggtttcatcgatttcatagtagagccaacattttctcttctgacagactcaacagagaaaattgttattcctcttatagaggaagcctcaaaagccgaaacttcttcctatgtggcaagcagctcaaccaccattgtggggttacacattgctgatgcactaagacgatcaaatacaaaaggctccatgagtgatgggtcctattccccagactactcccttgcagcagtggacctgaagagtttcaagaacaacctggtggacatcattcagcagaacaaagagaggtggaaagagttagctgcacaaggtgaatctgatcttcataagaactcagaagacttagtaaatgctgaagaaaaacatgatgagacacattcataggcccgaaacaccttaaagacttctgtcattttaaacatgagaggacaatgaaatcagcatgaaaacatcctaaattctcaactttccacaaagctatggctcttctttcaacatagaattggattgggccattttaattgactcctatacaaggaattaagaagaacataaattttgagctagtaactctggccaaataaatacactcaagtttttatcagagtttttggccagtgcttctgccatttttttccctccacaatttggccttcttcaatcaagccagataaatttttgagacaaaagtcagacagtttttaatttttcttgctttgaaccctgtcataatgactgtgcaatacatgtgcagaagatgaggtattttaaaatttacttccttgcactgtcttacacagagtgctataactataaatttttcaaggtcttaaataaaa

SEQ ID NO: 22244 - DNA, 3444 bp, Homo sapiens
gtaaacacgcactcacatccgccagtacagggcacacgcagccactcgtccccggcgcctgtgtgcgtgcgctcgcccttgggcgcttctgtctgtgtgtgcccccggcttccaatcgttcctttgggagggggaggagtggctgtgaggagtgagagactggcgggcaggctgaggagaagggagggagagcagagggaggggggaacccggccgggggaggaggagagaggcgaggaggcggctctggcagcgcgcggcggcggcggcggtagcggcagcagcagcggcggtgcggagagcttggactgggagcccaaagctcggctgggcagcgggagaggaggagccgcaggagctgcagctctgccagcttgggccgagcctagagacaccggcctggctggtccacgccagccgcagaccgtggctgagcatggagctgtccccccgcagtcctccggagatgctggaggagtcggattgcccgtcacccctggagctgaagtcagcccccagcaagaagatgtggattaagcttcggtctctgctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaataagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctccaagggagcgtggtcgtggaagaaacaacccacctgaaggccaaatgccagagatttggggttggggaaagggcccctccccacctgacacccactggggtgcactttaatgttccggcagcaagactggggaacttcaggctcccagtggtcactgtgcccatccctcagcctctggattctcttcatggccaggtggctgccagggagcggggagcttcctggaggcttcccagggccttggggaagggtcagagatgccagccccctgggacctcccccatcctttttgcctccaagtttctaagcaatacattttgggggttccctcagccccccaccccagatcttagctggcaggtctgggtgccccttttcctcccctgggaagggctggaataggatagaaagctgggggttttcagagccctatgtgtggggaggggagtggattccttcagggcatggtacctttctaggacctgggaatggggtggagaggacatcctcttcaccccagaattgcgctgcttcagccccatctccagcctgatcctctgaatcttccttccctccctttctgatacagtgactggggcaaaaggagccattgtgaccaggggctgcgggaggcctttcctgggaccttccttgggactggtctgggcccctggggcttgtcgcctgccctgagtccggagccctttgcctccttcctctcccctggggctgggaggctccatccgaccaatgtctgtaaagtgctttgaggatctccccagcaaagcaccttcagaatgtatcgacaccagctgggttagggtcaagggtgcctggggagggtgagtaatcctgcattgctaaaagagagggtctgtcccctcctctccacgtcccagaactggcccagctgcaggcactaagaagctcctcccctgagacaagtgaggggtagtcggtgaaaggcagatggacaaggggctcagggctgctgccttcctgtcctctggagagaacccagccaggcgcggtgccccttcctctcctcaggctcctccttgcccccaccttgccccaggaaaggccaaagtccaggtgactgccctccttctttcttgtaaataccaaccatgcatttgtacagtgggccctgttcatgcgaaatccacatccatggtctcctagacctgctaccctggtacttccaccctaccccaccccgagaagggcagagacgcatgtgactcacccctgcccttggtttcccagacccctgctatagccagagaacaataaagaagggagaccagg

SEQ ID NO: 22245 - DNA, 1711 bp, Homo sapiens
gattctctttggcacagatgttggcaggtgcgaggaagcacggccctgacacgcgtggccaggccacatgtgcaaggcatgtgcggagcaagctggccagttggagcgggcttaggagttgcaaaggctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaataagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctcc

SEQ ID NO: 22246 - DNA, 2150 bp, Homo sapiens
agttgctcagttctactgggacctggaggaggaaggcaggggccaaagaggaagttgtcccctcttgggggccctggggctcctggggtcaggattttgatactctgaagcaggaaactttgattcccatggcaaaccctgttcctgttcagaggagccacctccagggccccattctcaggctgcgctacatggtgaagcagttggagaatggggagataaacattgaggagctgaagaaaaatctggagtacacagcttctctgctggaagccgtctacatagatgagacacggcaaatcttggacacggaggacgagctgcaggagctgcggtcagatgccgtgccttcggaggtgcgggactggctggcctccaccttcacccagcaggcccgggccaaaggccgccgagcagaggagaagcccaagttccgaagcattgtgcacgctgtgcaggctgggatcttcgtggaacggatgttccggagaacatacacctctgtgggccccacttactctactgcggttctcaactgtctcaagaacctggatctctggtgctttgatgtcttttccttgaaccaggcagcagatgaccatgccctgaggaccattgtttttgagttgctgactcggcataacctcatcagccgcttcaagattcccactgtgtttttgatgagtttcctggatgccttggagacaggctatgggaagtacaagaatccttaccacaaccagatccacgcagccgatgttacccagacagtccattgcttcttgctccgcacagggatggtgcactgcctgtcggagattgagctcctggccatcatctttgctgcagctatccatgattatgagcacacgggcactaccaacagcttccacatccagaccaagtcagaatgtgccatcgtgtacaatgatcgttcagtgctggagaatcaccacatcagctctgttttccgattgatgcaggatgatgagatgaacattttcatcaacctcaccaaggatgagtttgtagaactccgagccctggtcattgagatggtgttggccacagacatgtcctgccatttccagcaagtgaagaccatgaagacagccttgcaacagctggagaggattgacaagcccaaggccctgtctctactgctccatgctgctgacatcagccacccaaccaagcagtggttggtccacagccgttggaccaaggccctcatggaggaattcttccgtcagggtgacaaggaggcagagttgggcctgcccttttctccactctgtgaccgcacttccactctagtggcacagtctcagatagggttcatcgacttcattgtggagcccacattctctgtgctgactgacgtggcagagaagagtgttcagcccctggcggatgaggactccaagtctaaaaaccagcccagctttcagtggcgccagccctctctggatgtggaagtgggagaccccaaccctgatgtggtcagctttcgttccacctgggtcaagcgcattcaggagaataagcagaaatggaaggaacgggcagcaagtggcatcaccaaccagatgtccattgacgagctgtccccctgtgaagaagaggcccccccatcccctgccgaagatgaacacaaccagaatgggaatctggattagccctggggctggcccaggtcttcattgagtccaaagtgtttgatgtcatcagcaccatccatcaggactggctcccccatctgctccaagggagcgtggtcgtggaagaaacaacccacctgaaggccaaatgccagagatttggggttggggaaagggcccctccccacctgacacccactggggtgcactttaatgttccggcagcaagactggggaacttcaggctcccagtggtcactgtgcccatccctcagcctctggattctcttcatggccaggtggctgccagggagcggggagcttcctggaggcttcccagggccttggggaagggtcagagatgccagccccctgggacctcccccatcctttttgcctccaagtttctaagcaatacattttgggggttccctcagccccccaccccagatcttagctggcaggtctgggtgccccttttcctcccct

SEQ ID NO: 22247 - DNA, 5109 bp, Homo sapiens
gacttccttgtttggagtaaacttcggcaacatctcatggctgaggggtttgcctttccatctgttgatgtgctttctggaagctccccggtctgccagagaaaacatatctagaagacgcacgacgccaattcagccattcccttgggtccccaaatccccccagccaccagagacggaaggagaaggtgaagtagaaaacagactttcctgtggcgcgcgggatccgcggctgacagagagtagcgtggccaggcagggatctccgcgcccaccggtcagccccgtccacgcgctcgggcgcgcgtcctcccttcctgacactcctctcgccgcctctggaactcggcttggagatggggcagtcgcgacggctcctgcctccgccgagctcctagcgctttagctgttgacattgggtccccgctgttgtctccaggcgctcagctgccagcgcgcggcggggctgagagtgacagcgcggcgcggccgggggaggattcgccgccgagccccgggctgctcactccgccgtgggggggaccgcagacgccgctggtctcgctgcgaggcccctgcccggccggccgagccatgacggacgccggcaacaggaaggagggcttcaaaaaatgccggagcgccactttcagcatcgatggctacagcttcaccatagttgcaaatgaagctggagacaagaatgccagaccactggcccgcttctctcggtctaagtcacagaactgtctgtggaactccctcatcgatgggctcacagggaatgtcaaggagaagccaaggccaacaattgtccatgaccctcgacccccagaggagatcctagctgatgaattgccacagctggatagctcagaagtcttggtgaagacatccttcagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctggatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaacttaaaaaaaaataaaattcctctcattgccacttttttcaatctctaaaagttagttgcccccaaaagaatattggtttaataatcatcatatttaagaaatgcactgataaaaacatattttccaattttaaatacacctatttaaaatgtaaatacacttatttaaaattcaagtaaatatgtaactatcaaagtaaatgtattcaaaacagaagttgtgcttctgaatgtaaaaatattaaaaggaagagaagacggatgaattgttgtattcatggacatttcagaattcacgcttataaagcaaatccaagttaaaaaacaaaaaaagatttttgtgcctcatgaagattgtgcctcatgcccaataacctcatgtactttgaaggatgtgaaggtttgcaagagatgcatttggcttcattttcctctaatcttttacttctacccacagtagatgatacaaaaaatcttgccttaaagactgcaggtttaagagtcattgcaaaagatgtcagtttgattttgtggtcctaggccaagagggtgtaaaattctgagcctagtttaaattctttattttcagattgttctggactgaaaataaagaatttaaactaggctagagatgcctttaagttacatttcagatcctcttcacagcacgctacatatctaaagcccttgagatcctgattgttctcacagttgttggtggaatccatagttttataactcacctctttttatggtggcattgttagcccttctgtgtctctccctaggatttttaattcaggactaaaatcacagaagtagcaaggaaaggctcaagactagagatagctttcaatctcttcagaaatagcctggtgcagtgagaaaactaggtttgttttcaggccagtctgatcttcatcctattctgtctataactagttgcaggtccttgctcggatggcataattttttgatgcctccatttgcttaactagaaactaggattcatatacacactctgcactttgtattgaagattaatgataatgtaggttttggttgctgtggctgagcctggccagtaataggtgcataacagaagtagctaagagcatttcataatcaggatgaactctccaggacagccctacaaagaaggagctgtttgttcccggatggcctcgaccttccaggcttgattgtaaagagtttagtgtcctctccttctctcattccctgcagttcatttccaataaactgcagttattcaagttgagcaagttccggaatttagtgcctaccatgctattgggcagtttatttataatgtgctttatgatgatacttcagagaaatttaattgctatacaaaaagacgaatcattgtgacttttcgttaaggaggcgattgcaattctttgctccctgcctggtgtctgggttagaaggcccttctgcaggctggtagtgtctgttccacctggattaggttaactcaacaggtaattcctatctgtttatacacagatgctttagcgcttgctgtacaaagtcatttggctacacactgaggaggcccatgggagtagtagcctcctcaaataatgttccctacctatctgtcaataccttccatcttaggtattgagaatttaatgaggctgtgttttcttggctgtgcttcttgatgttggaagccatgttcctggggaacaaatctgtattcttttctcctaagatgtgagtttttttcaacctttgctaatattttaatggagcaaatgtacagatgttgagattttgcactgcttataaaatgcctaccatgttttttgcataatggattgtatagaaatgcagattatattcttacagcaaataaaaagatgcttttaacaga

SEQ ID NO: 22248 - DNA, 2898 bp, Homo sapiens
agcaagaaaacatcaagagtttttgagtgtggtgtgtggttcccttcgtccccatcagtcgcttcaatatttcaaaatggatccggttctgtggcgggtgcgagagtgaggctgtgggggacctccaggcccaacctccgcgaagcctcgcggcttctgcgtgccctggccccgggaggataaggatttcccttccctcctacttgcgcgcggagccgagctcttgttgaggtgagggttccggaagcccacgcagctccgcaggtcggtggtggccgcggctgccctgcgggggtgagtgtgcccggccggggtcggagcccagcgtgtgcccggcagacggcggtgcccgcgcgcccctccctccgcgcccgcggtgacagcccagacaccagcccgggcgctgacagacgacttttctcacttgtcagttttctcgcttgtcagcagagctgctgctatggagtcgccaaccaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctggatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaacttaaa

SEQ ID NO: 22249 - DNA, 2420 bp, Homo sapiens
cggctcccgctttgctcagccgccgcttttctctcccttctcactttctctcctccccacccagccctccttttcacctccaaaccctttagctgcgcgctgatcgcttctgtggctttgtttgggggtagggggagaatacgaatagacccgaggtgctttctcttggagctggagtccaatcccaatccctatctctatccctatccctgtgcttatccctgggcattagcccgggaccatggctggttcccgcagctgcctccggagcgcacctggggccatggtttgccgcgatcggagtccgctctaagtcggagtctgggggcgcagaagggggagcgcgccgagaaagtgccgggcaaacgcgcgccgcgcctggctgggcatcgcgagctgggcgaggagacggggaggggacagcccaaactatctcagcttcaccgccagtggtcacctacctgcagctatggagtcgccaaccaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatgattcacaagagtaaaaaagacctcatagacaataaaagaggctgccagtgtcttgcatca

SEQ ID NO: 22250 - DNA, 8852 bp, Homo sapiens
gtggtgtgtggttcccttcgtccccatcagtcgcttcaatatttcaaaatggatccggttctgtggcgggtgcgagagtgaggctgtgggggacctccaggcccaacctccgcgaagcctcgcggcttctgcgtgccctggccccgggaggataaggatttcccttccctcctacttgcgcgcggagccgagctcttgttgagctatggagtcgccaaccaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatgattcacaagagtaaaaaagacctcatagacaataaaagaggctgccagtgtcttgcatcattctagctgagcttcttcattctccttcttctccttcttccacaaagacccatatctggagaaggtgtacaactttcaaacacaagccccccaccccctgacccttggccttccctcacaccatctccttccaggggatgaatctttgggggttggtttgaggtcttagaactctgggggatattcccctgagcaaaacaaacaacgtgagatttttactcaaacagaaacaaaacatgaaggggcatcctcaaaatcctttgctaatgacctggctttcaaggcatctgtctggcctgatgagaatggacatcctggatatgctgggagaggcctgaaaaaagccacacacacagtaattgccattttatgactgtcaatgccgttactttaaatgttgtcatttttgcactggctactgatgatacagccatgctgacattcatcaccgcaaagatgatgattccagtctctggttcctttcctgagtcaggaacatttgttttctccaatttcctttcagacttaaaattgttcttatgctttttttcccacttctgtaatacagaattctgtttgttttctaaaaaagattattctataggaatctttatttgatggctaatttattttctctgtgcattcattagtataaacctgaatgttcagctggtgactgtactgttgagtgggaacccattgtttccactggtagcattgataactaagtggttactgaaatttttaccactggctggacatcttcttttggatatctgtggttttatttcatcactcttctttttattcagtaaagtgctaagggaattagtatcagggagatatggcagataattctttgcattttagtgagtttttaaaaatacaagatagaagtggattaatagcacgaataaaaaataagaatagtagatgtagcatggaaagagaataacattgcagcccccttgagaccaaattacaggtgggatctaagggagtgcaagtaaagtgggattttatgagtctaaatgatgtgatttagataaaagtgattcttaaaatgtggttattggtcacacaggaatctctgagtccttcccaagagtgaagcacatgaatatgctgatgatgaagtggggattagtaatagaaagagagctaggcaataggtttaagtgtattccccactacagatttaatttctacatgaaaaagcacgagaacagatatttaaacgtccttttattactaaggtgaaatattggcattttttcaggcagaaagaaagagactgtatgtggtcttcctggacctttgccttgccaaaatgttccccaacagaaagatctgaagaactttgtagtatcgaatgcacaacagcatgctgatatttgaacagatttcttctgtcagctttacattttgccttggagaaacacttagatttttctgttgtgctccctgtgttcataacaatgacctcaccacataatgtggccagaaattcaaatgacttcaggggcctagcaggtcaagtaaatgaataaagcaagccatgtaatatcacagtcattgtggtaaatggcaattcatagtgggcctttgtatcagcaagacaggaaggagcaatggggactgtgagaaattggagagggtgggtgctgtcaaaacagggtagttggtaggcagcaactgaatttgagctgtgtggggatgggggtcctagatacctaggatttgatataagctctctccaaatttttacatattgacaactaactcaaaaacttacaaacactgtgctaatcaaatgaaacatgcctgtgagctgcattcaatccatggggcattggtttgcaagctatgttcttagaggtggtatgattttgtattgaaattaaatataaccaagagtatgtcaatttttgaccttggaacctggaccttttacctcatttatattctgtatttttgtatgtggggctttttggccagtcaaaatagaaagtctacagcttccattttataatctaacaagcaacaagaaacaacatttgaaaaagaaacaggaatatagccattttttctagcaccaataaaaatggaaatgtttttcatttgctttaagtcattaatcagctgaaaaagaatagaaagagaatttcattccataaagaacttcacctaaaactctcagtgaagcaaaacaaaactccatgtaactcactcttagctttaaatctttaaaaagtgtttcgaagggatattgagtaaaaatgcagttatctattaaaaatacaaaatgctatattatatgatgctatgaattgatactggagctgataaaacattaaagtaattattccaaatcagtgctgactgcaaaagcaatatttccaaagctctagcttattttctgcggtcttttaattcccttgaaatagctttcttcaagttgagcagcaatttgggacaaacattattctattgcacagattatggcatcttactctggtttacacacacagagcaagggcttacacacctgaattaagaattaactagcatgtggggacagcaatagggatagtcctaccacagacgaaaccatgcgctctacacgtccctggataaaatgtgacaagttagcccttgaatttgggtccccatgtcaccaaatagctctatatttaagttgtgttaatgtggtacgtttcagtggcataatgacccattcttatcgaggcctttgttccatattttatttgtgccaatctttcttaggttatgagccctaatagtttatggcagcagacaagagactcatttctaacccattaaattcaaatggactttcttccactgtccatttcatttttggagctgttataaactaccgaaaacatttgacaggatcccattgtggatctgatacacttaaacagtaaaatgatatctaaacatctgaaagccaaagaataacctagtgcacgtgttcattcatttgtagaatttaagccattgtattatattttccacttggaaccatgcctttagatacaaaagtgtaaagtaaaaagcaacattatcatgggatgtgagacggtaatccaaaagttgaagaccaatttttgttatccatattttggaagtatggatactgtttattttaatatcacttctctcatgggtcacttttccttagataggtaggtaggtagatagatagatagatagatgatagatagatagatagatagatagatagatagatagatagatagatagatagatagatagataatataatatattttcttctttcttaacctatgagcagagactttgatgatggaaattactttgtaacattccccatggagcctaggaaaaacaatagaaaaaaagcatgaaatctttttctcatagtgaaatagagaagattctaagattggaaatctgtgtatgtggtgttctatcccaaataaagagaatttagggaattcaggcaacaatttttttcctaattggaaactttgttctgatcctgagatgcccacacaccccacaggagacgcagtgctggcccaccacagtgtttggaacacggtcagcattcaggaaacacattcaaaatcgtctaactgaattccactatccacttgtgaatgcaaacaaaattcaaatttccctgaaaatttattcaacttctatatgccaagcacactgctaaaggcttatcttctaagtatatgcaggcataccctactcacacaaatagcttattaccagagataggaaattgcaggtaatttgggagaaattgtcatagccaaatttatggaaaaaataaaataaaaacttctctatggcctcttgatttaagaaaaaaacagaacaatacaaaaaaaaaaaagcactaaaacaggatttatctgagaatgtctttccaaaagggaagatgacaccaatctatataaaacgtcagtggatttactgagaatccgagtggaaacttttaaaaccttaaacagactctcctacagcaaatagattctctatgtgcagcatgaggaatcactgcatagttctgctccaccaataatatgattggtacagcaccaaaccatggcaaagttagatgttaaagaacataatgttgcaataatgatgttatattggatcttatgcatgaacaaatggaaagtaataatttatcaactgtgatccatgattaaaggcctcattatcactaagaaaatgaacttaatgaaaaaaattataatgagcaatgacaatattcctataaaacctccctctgggtatcaagagacatattacctgccaaggccagattttactttttaaggtttcctctctctcaccaaagacactagtgggcacagaggtgacactagagttagaatgttaccagagtcatttgcattagacagtttatctgatcatgaacatgttcccagggagattagaaaaatgggaagcaggcctctaaagatcctccttggacatttgtaaaaaggctggctgcttctccaggaatgtctgaattaagcaagaattgtgccactgaaatagcttcttgtttttatattaaacaaggaacgattgtgcagtggatgacctggactgaaagatgtatgatggtcaagtttaaacatattaattcctgattgttttcttaaatacccaccctagtcattttttggaaaatattgccagacatatttgacatgaattcatgtttattctggcttctgttcccaagcagaagtggattaaccctggcaatggctggcttcactaactgtacttgcacccagcctgggctgccatctgctcagccaggagaagcagggagtggggtgtgggccctttaagttcgctcagggcacactcattcagtctcccctgaggagaccttgtccccctttgtggggtgaatgctggctgttgcaggccagaggcagtgccaactggagactcatcctctcagctttggtcagcttcagccacgtattcttcatgagtgctggcttctgaacctgcaggatcatttctcagtcagtttatggtgcagggtaattcatttaaaataaagcccattaaaaccccatggctatagaatgggttttaaatagattgtcctggagacacatcattgtatagtctttgcttccctctcatgacctatcttggagtagaatttgtgtactactgtccttgtctttgagtgggtatatgtgtgatggtacagaaatacagtcacatattatattaatatatatagatggataggaaaaacctacagccataggtattgtccaataactgattctagaggtagaactatagagtatacatttccttttttcttgctttgatgatatttttatacaattttatatgctataaaattttcaaaaatatatttgctattttcatttgtagagcttggttaggtttttatcagctcttgtgcccactgtacaaccagattcccctcatctaatttaaatgtcttccctttttcaaactctcctttatgttttcctttttttttcctcccatttttctacccttcacaaattccttcttttgcttctgtccaggtaacccattctgcttgcagtatcattttagcacgtacaaacacaaaataatgggaaaaataaaagcaccttgttccatgcaattcgtatgggaaagttttgggtgtcaaaggtcgctggggatagatggggaggcagaaatagcttgggaaaaggaagcaggaaaaaaggaaatctttatgggaaatcaattacccaaagcaaggtgagtcacctagaggtgaatatgatgttgttattgtcctcccttagtgtacagcacagtttttgctctcacagggtttttctctttaggatgcgtagcaccctatgcattaaatacatagcatcctaaagacaccctactcaccttgagtctgtaggctctttcctgatgagggcactggccatatatgaatggaaaactcaactcatctcctcagctttagatgttgctgctgttcagctggatttgtgagaaatatctggattactatcaagaacatttagcaagactcaaaagagagaggcaagcagaaccaaaacccaaacctcaaccaatgactagctgaataaacaattctttggaggaataaggaaggtatttctggatgtattctgagaatgctcttccaaaagggaagatggtaataatggacttgttttgatttcatggttgtgatagaatgtacttccatgatgtgaaatacacttctggcagataaaatgcaggttgtaatttgcatttgtacatcacagggtaaaagaatggccatccattctgaggaagagtgttctgttctctaagatgctgcttaaccaatgttatccaaatgccatagcatcatatctccaaatacaagattaaatcataaggattcatgtaaaacagagtatactgagctgttctcagaaaaattaatgatgtgtttattgtaaatctttattgcacagatgagcctgacagtccttcaatgtataattttcccccagcatctagtaatgcataagtacttgtatgttcttctgattaccaaataaaaacaatgagttaacctcttaattggaattggaaaaatgaaaa

SEQ ID NO: 22251 - DNA, 605 bp, Homo sapiens
aagaaaacatcaagagtttttgagtgtggtgtgtggttcccttcgtccccatcagtcgcttcaatatttcaaaatggatccggttctgtggcgggtgcgagagtgaggctgtgggggacctccaggcccaacctccgcgaagcctcgcggcttctgcgtgccctggccccgggaggataaggatttcccttccctcctacttgcgcgcggagccgagctcttgttgagcccgggaccatggctggttcccgcagctgcctccggagcgcacctggggccatggtttgccgcgatcggagtccgctctaagtcggagtctgggggcgcagaagggggagcgcgccgagaaagtgccgggcaaacgcgcgccgcgcctggctgggcatcgcgagctgggcgaggagacggggaggggacagcccaaactatctcagcttcaccgccagtggtcacctacctgcagctatggagtcgccaaccaaggagattgaagaatttgagagcaactctctgaaatacctgcaaccggaacagatcgagaaaatctggcttcggctccgcgggctgaggaaatataagaaaacgtcccagagattacggtcttt

SEQ ID NO: 22252 - DNA, 2952 bp, Homo sapiens
gctcagccgccgcttttctctcccttctcactttctctcctccccacccagccctccttttcacctccaaaccctttagctgcgcgctgatcgcttctgtggctttgtttgggggtagggggagaatacgaatagacccgaggtgctttctcttggagctggagtccaatcccaatccctatctctatccctatccctgtgcttatccctgggcattagcccgggaccatggctggttcccgcagctgcctccggagcgcacctggggccatggtttgccgcgatcggagtccgctctaagtcggagtctgggggcgcagaagggggagcgcgccgagaaagtgccgggcaaacgcgcgccgcgcctggctgggcatcgcgagctgggcgaggagacggggaggggacagcccaaactatctcagcttcaccgccagtggtcacctacctgcagctatggagtcgccaaccaaggagattgaagaatttgagagcaactctctgaaatacctgcaaccggaacagatcgagaaaatctggcttcggctccgcgggctgaggaaatataagaaaacgtcccagagattacggtctttggtcaaacaattagagagaggggaagcttcagtggtagatcttaagaagaatttggaatatgcagccacagtgcttgaatctgtgtatattgatgaaacaaggagactcctggatacagaggatgagctcagtgacattcagtcagatgctgtgccttctgaggtccgagactggctggcctccaccttcacgcggcagatggggatgatgctcaggaggagcgacgagaagccccggttcaagagcatcgttcacgcagtgcaggctgggatatttgtggagagaatgtatagacggacatcaaacatggttggactgagctatccaccagctgttattgaggcattaaaggatgtggacaagtggtcctttgacgtcttttccctcaatgaggccagtggggatcatgcactgaaatttattttctatgaactactcacacgttatgatctgatcagccgtttcaagatccccatttctgcacttgtctcatttgtggaggccctggaagtgggatacagcaagcacaaaaatccttaccataacttaatgcacgctgccgatgttacacagacagtgcattacctcctctataagacaggagtggcgaactggctgacggagctggagatctttgctataatcttctcagctgccatccatgactacgagcataccggaaccaccaacaatttccacattcagactcggtctgatccagctattctgtataatgacagatctgtactggagaatcaccatttaagtgcagcttatcgccttctgcaagatgacgaggaaatgaatattttgattaacctctcaaaggatgactggagggagtttcgaaccttggtaattgaaatggtgatggccacagatatgtcttgtcacttccaacaaatcaaagcaatgaagactgctctgcagcagccagaagccattgaaaagccaaaagccttatcccttatgctgcatacagcagatattagccatccagcaaaagcatgggacctccatcatcgctggacaatgtcactcctggaggagttcttcagacagggtgacagagaagcagagctggggctgcctttttctcctctgtgtgaccgaaagtccactatggttgctcagtcacaagtaggtttcattgatttcatcgtggaacccaccttcactgtgcttacggacatgaccgagaagattgtgagtccattaatcgatgaaacctctcaaactggtgggacaggacagaggcgttcgagtttgaatagcatcagctcgtcagatgccaagcgatcaggtgtcaagacctctggttcagagggaagtgccccgatcaacaattctgtcatctccgttgactataagagctttaaagctacttggacggaagtggtgcacatcaatcgggagagatggagggccaaggtacccaaagaggagaaggccaagaaggaagcagaggaaaaggctcgcctggccgcagaggagcagcaaaaggaaatggaagccaaaagccaggctgaagaaggcgcatctggcaaagctgagaaaaagacgtctggagaaactaagaatcaagtcaatggaacacgggcaaacaaaagtgacaaccctcgtgggaaaaactccaaagccgagaagtcatcaggagaacagcaacagaatggtgacttcaaagatggtaaaaataagacagacaagaaggatcactctaacatcggaaatgattcaaagaaaacagatggcacaaaacagcgttctcacggctcaccagccccaagcaccagctccacgtgtcgccttacgttgccagtcatcaagcctcctttgcgtcattttaaacgccctgcttacgcatctagctcctatgcaccttcagtctcaaagaaaactgatgagcatcctgcaaggtacaagatgctggatcagaggatcaaaatgaaaaagattcagaacatctcacataactggaacagaaaataggccgaggggaagaagagagggagtgaaggagggtctacctatctgcttctcagcacccactggccacagcaggacacacctccaagacccttggaggctgttggagcaggtactatcctggttgactccaccaaggtgaaatgaaagttgtatgtgattttcctctttgttgttcttgtatagacttttcaattgctgtatgtgggatcagcccagacgccagcaacaaactagcaagaggggtgtttttatggtataagtctctaaaagtctaaattggaccaaaattaaaatgacacaaacttaaaaaaaaataaaattcctctcattgccacttttttcaatctctaaaagttagttgccccc

SEQ ID NO: 22253 - DNA, 4836 bp, Homo sapiens
gctcgcgcgcccaacggaccaggctggggccgtgaggtaactgttgcagccagcggaggtgggaggcgacactgagtctccagtcccgagaggtgcccgagggaaaaggaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaagtcatttcctctctacggagtattagtagcttaatgggtgctttctcaggttcctgtaggccaaagattaatcctctcacaccatttcctggattttacccctgttctgaaatagaggacccagctgagaaaggggatagaaaacttaacaagggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgttgcagagcccttacttaaatccttcactggtgtatgaatactttgtcataatgctgctttgctgggtagtgagctcttatttttcactgggggtcagctataactaaaaactcaagtgacatatttcagttaccaaagtggccaggaactttttgcttttatgaaaatagattcatattgtatttcccagtgtgtcttttatgtctttgaatgttttggagaaaagtctatgcctgtctaaaaatgaatccagtgttgcctttctgagggatttctgctcaatgcaatacactgttcagtgctattctcccagctaggtttatccatgaaggactgagtgacctttgttgtatttaacaaaatccaggtgcatcaatttctgatgctttttactattgtgtattatctactatgtgtgttttatttctgctgagagtattcaggtttgccatggacatcagaagtttgaattccagtcttatcttatgttccatggctgaattttaaagctgtttaggtttaacaatgaagggatttattctttagtcaaaattgttgtttttactctagctcaggattcgtatttttaaagatttagttaatatgaacacagcacagatttgttagaagaaaaaaaatttgctgtaataccaaaactaacctcatcaaagatacagaaaaaaagaaatatagtgagccctaaaggacacatacattgaataaataattggaacatgtggttatctttagatccacatcttagctgtcatttgttcactctaaaactgatgttcatctttctgttaatttccctctgcctaaagactacatgacagaaatgacctatcactacttattatttctgaagcctaactgcaagactgatttctgagaacaagtaaagaactgg

SEQ ID NO: 22254 - DNA, 3665 bp, Homo sapiens
gaggcggcagctaaactggtcctggagagaagccccttccgcccctctcctcagccagcatgtcccggactccgccgctcctcagtccgcgcggtggggaccccgggccgtggcggccggcgcagccctgacgggttgcgaaccagggggcgccccgaacgcgggggttggggtctgggagcgcgagcggccgctacggtacgagcggggtgtgctgagtcccgtggccacccccggccccagccatgaggagggacgagcgagacgccaaagccatgcggtccctgcagccgccggatggggccggctcgccccccgagagtctgaggaacggctacgtgaagagctgcgtgagccccttgcggcaggaccctccgcgcggcttcttcttccacctctgccgcttctgcaacgtggagctgcggccgccgccggcctctccccagcagccgcggcgctgctcccccttctgccgggcgcgcctctcgctgggcgccctggctgcctttgtcctcgccctgctgctgggcgcggaacccgagagctgggctgccggggccgcctggctgcggacgctgctgagcgtgtgttcgcacagcttgagccccctcttcagcatcgcctgtgccttcttcttcctcacctgcttcctcacccggaccaagcggggacccggcccgggccggagctgcggctcctggtggctgctggcgctgcccgcctgctgttacctgggggacttcttggtgtggcagtggtggtcttggccttggggggatggcgacgcagggtccgcggccccgcacacgcccccggaggcggcagcgggcaggttgctgctggtgctgagctgcgtagggctgctgctgacgctcgcgcacccgctgcggctccggcactgcgttctggtgctgctcctggccagcttcgtctggtgggtctccttcaccagcctcgggtcgctgccctccgccctcaggccgctgctctccggcctggtggggggcgctggctgcctgctggccctggggttggatcacttctttcaaatcagggaagcgcctcttcatcctcgactgtccagtgccgccgaagaaaaagtgcctgtgatccgaccccggaggaggtccagctgcgtgtcgttaggagaaactgcagccagttactatggcagttgcaaaatattcaggagaccgtcgttgccttgtatttccagagaacagatgattctttgggattgggacttaaaacaatggtataagcctcattatcaaaattctggaggtggaaatggagttgatctttcagtgctaaatgaggctcgcaatatggtgtcagatcttctgactgatccaagccttccaccacaaggactaaataggaatagtttgccaactccacagctgaggagaagctcaggaacttcaggattgctacctgttgaacagtcttcaaggtgggatcgtaataatggcaaaagacctcaccaagaatttggcatttcaagtcaaggatgctatctaaatgggccttttaattcaaatctactgactatcccgaagcaaaggtcatcttctgtatcactgactcaccatgtaggtctcagaagagctggtgttttgtccagtctgagtcctgtgaattcttccaaccatggaccagtgtctactggctctctaactaatcgatcacccatagaatttcctgatactgctgattttcttaataagccaagcgttatcttgcagagatctctgggcaatgcacctaatactccagatttttatcagcaacttagaaattctgatagcaatctgtgtaacagctgtggacatcaaatgctgaaatatgtttcaacatctgaatcagatggtacagattgctgcagtggaaaatcaggtgaagaagaaaacattttctcgaaagaatcattcaaacttatggaaactcaacaagaagaggaaacagagaagaaagacagcagaaaattatttcaggaaggtgataagtggctaacagaagaggcacagagtgaacagcaaacaaatattgaacaggaagtatcactggacctgattttagtagaagagtatgactcattaatagaaaagatgagcaactggaattttccaatttttgaacttgtagaaaagatgggagagaaatcaggaaggattctcagtcaggttatgtataccttatttcaagacactggtttattggaaatatttaaaattcccactcaacaatttatgaactattttcgtgcattagaaaatggctatcgagacattccttatcacaatcgtatacatgccacagatgtgctacatgcagtttggtatctgacaacacggccagttcctggcttacagcagatccacaatggttgtggaacaggaaatgaaacagattctgatggtagaattaaccatgggcgaattgcttatatttcttcgaagagctgctctaatcctgatgagagttatggctgcctgtcttcaaacattcctgcattagaattgatggctctatacgtggcagctgccatgcatgattatgatcacccagggaggacaaatgcatttctagtggctacaaatgcccctcaggcagttttatacaatgacagatctgttctggaaaatcatcatgctgcgtcagcttggaatctatatctttctcgcccagaatacaacttccttcttcatcttgatcatgtggaattcaagcgctttcgttttttagtcattgaagcaatccttgctacggatcttaaaaagcattttgattttctcgcagaattcaatgccaaggcaaatgatgtaaatagtaatggcatagaatggagtaatgaaaatgatcgcctcttggtatgccaggtgtgcatcaaactggcagatataaatggcccagcaaaagttcgagacttgcatttgaaatggacagaaggcattgtcaatgaattttatgagcagggagatgaagaagcaaatcttggtctgcccatcagtccattcatggatcgttcttctcctcaactagcaaaactccaagaatcttttatcacccacatagtgggtcccctgtgtaactcctatgatgctgctggtttgctaccaggtcagtggttagaagcagaagaggataatgatactgaaagtggtgatgatgaagacggtgaagaattagatacagaagatgaagaaatggaaaacaatctaaatccaaaaccaccaagaaggaaaagcagacggcgaatattttgtcagctaatgcaccacctcactgaaaaccacaagatatggaaggaaatcgtagaggaagaagaaaaatgtaaagctgatgggaataaactgcaggtggagaattcctccttacctcaagcagatgagattcaggtaattgaagaggcagatgaagaggaatagcgacagtttgagtaaaagaaaagtcatattgaagaagcccagagggttgtgcccaggggcagaaatcattgcctagtgttcaccggctgactctcaactgaccattcccatgtggacaggccttaatactgtgagaggatccttgctctgctggcagtttcccactcctatgcactttcacaggaactagaaaactattcttaaaccaaaaataccatccgtgttgacccatgt

SEQ ID NO: 22255 - DNA, 4591 bp, Homo sapiens
atggcgcggccgcgcggcctaggccgcatcccggagctgcaactggtggccttcccggtggcggtggcggctgaggacgaggcgttcctgcccgagcccctggccccgcgcgcgccccgccgcccgcgttcgccgccctcctcgcccgtcttcttcgccagcccgtccccaactttccgcagacgccttcggcttctccgcagctgccaggatttgggccgccaggcttgggctggggctggcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccg

SEQ ID NO: 22256 - DNA, 4259 bp, Homo sapiens
tccgcagcctcctcctgggacccttgccctgcccccctcccatgggcacggaccccccaccgcctccacccactgccgcgggggggcccgttggggcccagggctggcgggccatgtaaccagggctgctgctgggagcgcggaggggaagggagcccccagccctgctgggccggcccaggcccctccgcggctcccccttccactacccacctgcccggcaccccctccccagtggttgttaaccccgggactccccaagcccagcctctgtgtgcagcagccccaggcgggctaagtctccaagatgcccttggtggatttcttctgcgagacctgctctaagccttggctggtgggctggtgggaccagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccg

SEQ ID NO: 22257 - DNA, 4777 bp, Homo sapiens
cggccgggcgcacccgcggggccctgggctcgctggcttgcgcgcagctgagcggggtgtaggttggaagggccagggccccctggggcgcaagtgggggccggcgccatggaacccccgaccgtcccctcggaaaggagcctgtctctgtcactgcccgggccccgggagggccaggccaccctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcgcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccg

SEQ ID NO: 22258 - DNA, 969 bp, Homo sapiens
atggtgcttccttcagaccaaggcttcaaactcctaggaaatgttctccagggccctgagccttacaggcttctgacctctggcctccgtctccaccaggaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtacaggctcggggcattgatggacgggcacagggtgagttttat

SEQ ID NO: 22259 - DNA, 4603 bp, Homo sapiens
atgaagaggagtcgcagtgccctgtccgtggcagggaccggggacgagaggtcgagggagacccccgaatccgaccgtgccaacatgctgggggccgacctgcgtcgccctcgccgccgcctctcgtccggtcctggcctgggctgggcccagcctgagccctcggaccctggggtccctctgccgccacggcccaccaccctgccgctgctgatcccaccgcggatttccatcaccagggccgagaacgacagcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccg

SEQ ID NO: 22260 - DNA, 2707 bp, Homo sapiens
cgtcacgccccaggagaggcaataggaggccctggccctgccgacatggccaccgcagtcccaacggcgcgctaggttggcgagatgaagaggagtcgcagtgccctgtccgtggcagggaccggggacgagaggtcgagggagacccccgaatccgaccgtgccaacatgctgggggccgacctgcgtcgccctcgccgccgcctctcgtccggtcctggcctgggctgggcccagcctgagccctcggaccctggggtccctctgccgccacggcccaccaccctgccgctgctgatcccaccgcggatttccatcaccagggccgagaacgacagcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctc

SEQ ID NO: 22261 - DNA, 4486 bp, Homo sapiens
atgcgctccggtgcagcgccccgggcccggccccggccccctgccctggcactgccccccacgggccccgagtccctgacccacttccccttcagcgatgaggacacccgtcggcaccctccgggcagatctgtcagcttcgaggcagagaatgggccgacaccatctcctggccgcagccccctggactcgcaggcgagcccaggactcgtgctgcacgccggggcggccaccagccagcgccgggagtccttcctgtaccgctcagacagcgactatgacatgtcacccaagaccatgtcccggaactcatcggtcaccagcgaggcgcacgctgaagacctcatcgtaacaccatttgctcaggtgctggccagcctccggagcgtccgtagcaacttctcactcctgaccaatgtgcccgttcccagtaacaagcggtccccgctgggcggccccacccctgtctgcaaggccacgctgtcagaagaaacgtgtcagcagttggcccgggagactctggaggagctggactggtgtctggagcagctggagaccatgcagacctatcgctctgtcagcgagatggcctcgcacaagttcaaaaggatgttgaaccgtgagctcacacacctgtcagaaatgagcaggtccggaaaccaggtctcagagtacatttccacaacattcctggacaaacagaatgaagtggagatcccatcacccacgatgaaggaacgagaaaaacagcaagcgccgcgaccaagaccctcccagccgcccccgccccctgtaccacacttacagcccatgtcccaaatcacagggttgaaaaagttgatgcatagtaacagcctgaacaactctaacattccccgatttggggtgaagaccgatcaagaagagctcctggcccaagaactggagaacctgaacaagtggggcctgaacatcttttgcgtgtcggattacgctggaggccgctcactcacctgcatcatgtacatgatattccaggagcgggacctgctgaagaaattccgcatccctgtggacacgatggtgacatacatgctgacgctggaggatcactaccacgctgacgtggcctaccataacagcctgcacgcagctgacgtgctgcagtccacccacgtactgctggccacgcctgcactagatgcagtgttcacggacctggagattctcgccgccctcttcgcggctgccatccacgatgtggatcaccctggggtctccaaccagttcctcatcaacaccaattcggagctggcgctcatgtacaacgatgagtcggtgctcgagaatcaccacctggccgtgggcttcaagctgctgcaggaggacaactgcgacatcttccagaacctcagcaagcgccagcggcagagcctacgcaagatggtcatcgacatggtgctggccacggacatgtccaagcacatgaccctcctggctgacctgaagaccatggtggagaccaagaaagtgaccagctcaggggtcctcctgctagataactactccgaccgcatccaggtcctccggaacatggtgcactgtgccgacctcagcaaccccaccaagccgctggagctgtaccgccagtggacagaccgcatcatggccgagttcttccagcagggtgaccgagagcgcgagcgtggcatggaaatcagccccatgtgtgacaagcacactgcctccgtggagaagtctcaggtgggttttattgactacattgtgcacccattgtgggagacctgggcggaccttgtccacccagatgcccaggagatcttggacactttggaggacaaccgggactggtactacagcgccatccggcagagcccatctccgccacccgaggaggagtcaagggggccaggccacccacccctgcctgacaagttccagtttgagctgacgctggaggaggaagaggaggaagaaatatcaatggcccagataccgtgcacagcccaagaggcattgactgcgcagggattgtcaggagtcgaggaagctctggatgcaaccatagcctgggaggcatccccggcccaggagtcgttggaagttatggcacaggaagcatccctggaggccgagctggaggcagtgtatttgacacagcaggcacagtccacaggcagtgcacctgtggctccggatgagttctcgtcccgggaggaattcgtggttgctgtaagccacagcagcccctctgccctggctcttcaaagcccccttctccctgcttggaggaccctgtctgtttcagagcatgccccgggcctcccgggcctcccctccacggcggccgaggtggaggcccaacgagagcaccaggctgccaagagggcttgcagtgcctgcgcagggacatttggggaggacacatccgcactcccagctcctggtggcggggggtcaggtggagaccctacctgatccccagacctctgtccctgttcccctccactcctcccctcactcccctgctcccccgaccacctcctcctctgcctcaaagactcttgtcctcttgtccctcctgagaaaaaagaaaacgaaaagtggggtttttttctgttttctttttttcccctttccccctgcccccacccacggggcctttttttggaggtgggggctggggaatgaggggctgaggtcccggaagggattttatttttttgaattttaattgtaacatttttagaaaaagaacaaaaaaagaaaaaaaaaagaaagaaacacagcaactgtagatgctcctgttcctggttcccgctttccacttccaaatccctcccctcaccttcccccactgccccccaagttccaggctcagtcttccagccgcctggggagtctctacctgggcccaagcaggtgtggggcctccttctgggcttttcttctgaatttagaggatttctagaacgtggtcaggaatagccattctaggcggggctggggccagggtggggggcagtcactgtgggaggtcccagctccagcccccctctggtttgctgcctcctctcccctctaaaaaagtcttccgcttgattttgcacaatcccggcgatactcctggcgatactgactagaaagtcagggagctgggggagctgttcactttaggatacgggggtggtatggaagggagcgttcacaccgccagcctcgggcctgggatttgaggagggccctagacctcctccactctccatcccctttcccttccactttgggttcactttgaattttctccgttttttggggcagtggctctgatccactcacccccccgccccccgccccacttctagctgcttctcctcttgtttctgccttaataattcccacggccacaggcaagggggttgcagtggccgcctgcaccttggatgaggcagggccaggcgcccagaacccccatcctggccgcacccccctttccagggtcctccggaccccaccttccacactctgatcacagcccccctaccttttgccctaggaggaagcaataatggtgtataccctcattctcattcctgggcagcccttccttccaccctggcaccaaaataatttctcctccatccgtaccttgcctagcctctccctctcccccagctagtccctgagcaatacggcagacagatgcaagaccatttttctccaagccatgggggactgtttggaaggaaagccccctctctccctcctcccctcgccctcggcctggttctgcagctggaccgacctcattcatcgcctgccccctacccaattctgagcacacggtactgtagcccccagttcctccctagccttccatccctctgtccaccccagggggaggtaaccccgcactcacactcccttgatgctgtctgtacagggttcatattttgtagcgaaagtcgtttttgtcccagccggcgatcggagtgggccttttctttctttttgttcattctttacctttttttcttttctttctttcttttttgtacatactgtaaggttggtttgtaaattattctacggaggcaaaaagggaaaataaaaacttgcccttccctggctgacccagtcgggaaggtagggaaggaggtctcccgttgggagagtctctgttcctgctgtattatacaaactgtaccatagtcctgggaaaagggtggactcaccgctgttgttttatgggaagtcgtgtcatcctaggggttggggctgggcagagcctgtcccctccccccttctccaggagccagggggtgactggagagacagacccacccccaagcagggctcctctccccagggtgagcacaggacctctgtaagctgcttgtgtattgtccactttgacgatcagtcattcggtccgttgatcaataatccttcgatcttgtctccaattaaaccgaggctttcaccg

SEQ ID NO: 22262 - DNA, 3998 bp, Homo sapiens
gtaatccttcagctctggtggtaagggagatgcagtgagctcccggctgggagagagggttattttgcaaaactcccctggtaccgtgcccgcggaatattgcaggaggtctgtgaggtattaaaaagtgtcagcaaactgcattgaataacagacatcctaagaggggatattttccacctctataatgaagaaaagcaggagtgtgatgacggtgatggctgatgataatgttaaagattattttgaatgtagcttgagtaaatcctacagttcttccagtaacacacttgggatcgacctctggagagggagaaggtgttgctcaggaaacttacagttaccaccactgtctcaaagacagagtgaaagggcaaggactcctgagggagatggtatttccaggccgaccacactgcctttgacaacgcttccaagcattgctattacaactgtaagccaggagtgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaa

SEQ ID NO: 22263 - DNA, 3175 bp, Homo sapiens
gcggccgcggcggtgcagcagaggcgcctcgggcaggaggagggcggcttctgcgagggcagcctgaggtattaaaaagtgtcagcaaactgcattgaataacagacatcctaagaggggatattttccacctctataatgaagaaaagcaggagtgtgatgacggtgatggctgatgataatgttaaagattattttgaatgtagcttgagtaaatcctacagttcttccagtaacacacttgggatcgacctctggagagggagaaggtgttgctcaggaaacttacagttaccaccactgtctcaaagacagagtgaaagggcaaggactcctgagggagatggtatttccaggccgaccacactgcctttgacaacgcttccaagcattgctattacaactgtaagccaggagtgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgc

SEQ ID NO: 22264 - DNA, 3979 bp, Homo sapiens
aaccagttttcacccgaattttgactgtttcatttagaagaaaagcaaaatgagaaaaagctttcctcatttctccttgagatggcaaagcactcagaaatgacatcacataccctaaagaaccctgggatgactaaggcagagagagtctgagaaaactctttggtgcttctgcctttagttttaggacacatttatgcagatgagcttataagagaccgttccctccgccttcttcctcagaggaagtttcttggtagatcaccgacacctcatccaggcggggggttggggggaaacttggcaccagccatcccaggcagagcaccactgtgatttgttctcctggtggagagagctggaaggaaggagccagcgtgcaaataatgaaggagcacgggggcaccttcagtagcaccggaatcagcggtggtagcggtgactctgctatggacagcctgcagccgctccagcctaactacatgcctgtgtgtttgtttgcagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgattaga

SEQ ID NO: 22265 - DNA, 2211 bp, Homo sapiens
atgaagaaaagcaggagtgtgatgacggtgatggctgatgataatgttaaagattattttgaatgtagcttgagtaaatcctacagttcttccagtaacacacttgggatcgacctctggagagggagaaggtgttgctcaggaaacttacagttaccaccactgtctcaaagacagagtgaaagggcaaggactcctgagggagatggtatttccaggccgaccacactgcctttgacaacgcttccaagcattgctattacaactgtaagccaggagtgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataa

SEQ ID NO: 22266 - DNA, 4546 bp, Homo sapiens
cacatgctggacggattctgggtctgctctttgtgcaaacaaaacaagtgactaggttttgcttactatccattagtgaatgcagcttgtttaataagattttttttaaaaaaatgcatgtaaaggatttatcaaaagcctttatgaatatttcatgagttgatatattcagctgaatgaattcagtgagtgtcagtgtgtagcttgcagacaaacctcatccacaaggaggctactgacattggaagcactttggcgcattttcagaggcaaagccagcctgataaagctccttgtgacagcctgacttgctattcttcgagtatgctgctcttgctctaagacgctcatacattggagtcacagcttcgtaaattaaactggaaatagtttgcagacttatcagtcttctgacctgcagcagtgtctctgctatgtttgagatttttgttttggatggtgaaagctagcactccttacaagacatgacagcaaaagattcttcaaaggaacttactgcttctgaacctgaggtttgcataaagactttcaaggagcaaatgcatttagaacttgagcttccgagattaccaggaaacagacctacatctcctaaaatttctccacgcagttcaccaaggaactcaccatgctttttcagaaagttgctggtgaataaaagcattcggcagcgtcgtcgcttcactgtggctcatacatgctttgatgtggaaaatggcccttccccaggtcggagtccactggatccccaggccagctcttccgctgggctggtacttcacgccacctttcctgggcacagccagcgcagagagtcatttctctacagatcagacagcgactatgacttgtcaccaaaggcgatgtcgagaaactcttctcttccaagcgagcaacacggcgatgacttgattgtaactccttttgcccaggtccttgccagcttgcgaagtgtgagaaacaacttcactatactgacaaaccttcatggtacatctaacaagaggtccccagctgctagtcagcctcctgtctccagagtcaacccacaagaagaatcttatcaaaaattagcaatggaaacgctggaggaattagactggtgtttagaccagctagagaccatacagacctaccggtctgtcagtgagatggcttctaacaagttcaaaagaatgctgaaccgggagctgacacacctctcagagatgagccgatcagggaaccaggtgtctgaatacatttcaaatactttcttagacaagcagaatgatgtggagatcccatctcctacccagaaagacagggagaaaaagaaaaagcagcagctcatgacccagataagtggagtgaagaaattaatgcatagttcaagcctaaacaatacaagcatctcacgctttggagtcaacactgaaaatgaagatcacctggccaaggagctggaagacctgaacaaatggggtcttaacatctttaatgtggctggatattctcacaatagacccctaacatgcatcatgtatgctatattccaggaaagagacctcctaaagacattcagaatctcatctgacacatttataacctacatgatgactttagaagaccattaccattctgacgtggcatatcacaacagcctgcacgctgctgatgtagcccagtcgacccatgttctcctttctacaccagcattagacgctgtcttcacagatttggagatcctggctgccatttttgcagctgccatccatgacgttgatcatcctggagtctccaatcagtttctcatcaacacaaattcagaacttgctttgatgtataatgatgaatctgtgttggaaaatcatcaccttgctgtgggtttcaaactgctgcaagaagaacactgtgacatcttcatgaatctcaccaagaagcagcgtcagacactcaggaagatggttattgacatggtgttagcaactgatatgtctaaacatatgagcctgctggcagacctgaagacaatggtagaaacgaagaaagttacaagttcaggcgttcttctcctagacaactataccgatcgcattcaggtccttcgcaacatggtacactgtgcagacctgagcaaccccaccaagtccttggaattgtatcggcaatggacagaccgcatcatggaggaatttttccagcagggagacaaagagcgggagaggggaatggaaattagcccaatgtgtgataaacacacagcttctgtggaaaaatcccaggttggtttcatcgactacattgtccatccattgtgggagacatgggcagatttggtacagcctgatgctcaggacattctcgataccttagaagataacaggaactggtatcagagcatgatacctcaaagtccctcaccaccactggacgagcagaacagggactgccagggtctgatggagaagtttcagtttgaactgactctcgatgaggaagattctgaaggacctgagaaggagggagagggacacagctatttcagcagcacaaagacgctttgtgtgattgatccagaaaacagagattccctgggagagactgacatagacattgcaacagaagacaagtcccccgtggatacataatccccctctccctgtggagatgaacattctatccttgatgagcatgccagctatgtggtagggccagcccaccatgggggccaagacctgcacaggacaagggccacctggcctttcagttacttgagtttggagtcagaaagcaagaccaggaagcaaatagcagctcaggaaatcccacggttgacttgccttgatggcaagcttggtggagagggctgaagctgttgctgggggccgattctgatcaagacacatggcttgaaaatggaagacacaaaactgagagatcattctgcactaagtttcgggaacttatccccgacagtgactgaactcactgactaataacttcatttatgaatcttctcacttgtccctttgtctgccaacctgtgtgccttttttgtaaaacattttcatgtctttaaaatgcctgttgaatacctggagtttagtatcaacttctacacagataagctttcaaagttgacaaacttttttgactctttctggaaaagggaaagaaaatagtcttccttctttcttgggcaatatccttcactttactacagttacttttgcaaacagacagaaaggatacacttctaaccacattttacttccttcccctgttgtccagtccaactccacagtcactcttaaaacttctctctgtttgcctgcctccaacagtacttttaactttttgctgtaaacagaataaaattgaacaaattagggggtagaaaggagcagtggtgtcgttcaccgtgagagtctgcatagaactcagcagtgtgccctgctgtgtcttggaccctgccccccacaggagttgtacagtccctggccctgttccctacctcctctcttcaccccgttaggctgttttcaatgtaatgctgccgtccttctcttgcactgccttctgcgctaacacctccattcctgtttataaccgtgtatttattacttaatgtatataatgtaatgttttgtaagttattaatttatatatctaacattgcctgccaatggtggtgttaaatttgtgtagaaaactctgcctaagagttacgactttttcttgtaatgttttgtattgtgtattatataacccaaacgtcacttagtagagacatatggcccccttggcagagaggacaggggtgggcttttgttcaaagggtctgccctttccctgcctgagttgctacttctgcacaacccctttatgaaccagttttggaaacaatattctcacattagatactaaatggtttatactgagcttttacttttgtatagcttgataggggcagggggcaatgggatgtagtttttacccaggttctatccaaatctatgtgggcatgagttgggttataactggatcctactatcattgtggctttggttcaaaaggaaacactacatttgctcacagatgattcttctgaatgctcccgaactactgactttgaagaggtagcctcctgcctgccattaagcaggaatgtcatgttccagttcattacaaaagaaaacaataaaacaatgtgaatttttataataaaatgtgaactgatgtagcaaattacgcaaatgtgaagcctcttctgataacacttgttaggcctcttactgatgtcagtttcagtttgtaaaatatgtttcatgctttcagttcagcattgtgactcagtaattacagaaaatggcacaaatgtgcatgaccaatgtatgtctatgaacactgcattgtttcaggtggacattttatcattttcaaatgtttctcacaatgtatgttatagtattattattatatattgtgttcaaatgcattctaaagagacttttatatgaggtgaataaagaaaagcatgatt

SEQ ID NO: 22267 - DNA, 5034 bp, Homo sapiens
ccagcctccacgcagtcctggcgatgcagggcccccccgcgcccgccccggtccccgggcccggctcccctcggggatccccgcgcggctcccccgggctcttcaggaagcttttggtgaatcagagcatccgcctgcagcggcgcttcacggtggcccatccgctgtgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgtgccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctgggcgacagagcaagacactgtctcaaaaaagaaaagaaaaaaaaaaaagccgggccaggtggctcacgcctgtaatcctagcactttgggaggctgagtgggggtggatcgcctgagatcaggagttcaaaatcagcctggccaacatagtgaaaccctgtctctactaaaaatacaaaaaattagaggctgggtgcggcggctcacacctgtaatcccagaactttgggaggccgaggcgggtggatcacgaggtcaggagttcaagaccagcctggccaacacggtgaaaccccatctctactaaaaatacacaaattagctgggcatggtgttgggtgcctgaatcccagctactcgggaggctgaggcaggagaatcgcttgaatccgggaggcggggcttgcagtgagccgagatcgtgccattgcactccagcctgggtgacagagcaagactccgtctcaaaaagaaaaaaaaaaaattagccaggcatggtggcaggtgcctgtaatcccagctacttgagaggctgaggcaggagaatcgcttgaacccgggaggtggaggttgtggtgagccgaggtcgcgccactgcactccagcctgggcaacgacaacaacaataaaaagagggggctctgtgcccggcatgtctctgaagactgattgaacctatgcaccagttgttgctttaagtcgctttattttctgtctttggtgtctctggatgtaggagccccctgctttctctgtccgcagaactccatactgggtcccctacgtgttcctccttccctaggacagcaacaaaaacacacaattttccctctctagcaggtctctaagtctcctgattcctgaaactgcctcagactccccctagagggagggaggcccctgaggctttcttgccatcatagcctcttctgggcctcagtttcccctctgtaacctgatcctagtacttggataaactccgacgaggtgtggggggttgttgtctgtgacctccctgaaatatcttagacatttggggtactgagcatttatctggggttaaataaaatctttacatcttaagacattcgattgaccaaattgagtgtcctggccatttcactgatgaggaaactgaggcgcagagaggtcctcttgccagctcaaagtcaagcatctgggcgcccaatgttagccagcggcaccccctggtggcgggcgtgggagacacggcggggcgcgcttgtcgggggttggggggtgggtcggaggggtggcatcctccagccctgatggtcccacttaccgcacctcgccgggaagagctcgtcctgctggtcgggcctccgagcggactgggcagcaccatgctcaagcctagggttcgatccccgcctccggaagcctcagtatccatccctcccctctgcctccctcttcgcgtgcctgaatatttatacaagatacaggcgtcatcacagccgccctcggcttccagagcagctggcttcgttcataaatattataaccactcagaattcatcatcatcacagttaatgataaaattccacagtgccagaactaaaagtcatccgggttcacgaacttggtgcatttccttccagacttttaaaaagaagatatttagggaatttttttttcaagatttttccccccagtccgcttacaaagtaataccatgttcgctgtaaaaaatttggaaataatggaaatgtataaagaaggaaataaaattctgctgtatctccaccca

SEQ ID NO: 22268 - DNA, 5181 bp, Homo sapiens
atgggacccaggcaggactccgcagtggtgcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgtgccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctgggcgacagagcaagacactgtctcaaaaaagaaaagaaaaaaaaaaaagccgggccaggtggctcacgcctgtaatcctagcactttgggaggctgagtgggggtggatcgcctgagatcaggagttcaaaatcagcctggccaacatagtgaaaccctgtctctactaaaaatacaaaaaattagaggctgggtgcggcggctcacacctgtaatcccagaactttgggaggccgaggcgggtggatcacgaggtcaggagttcaagaccagcctggccaacacggtgaaaccccatctctactaaaaatacacaaattagctgggcatggtgttgggtgcctgaatcccagctactcgggaggctgaggcaggagaatcgcttgaatccgggaggcggggcttgcagtgagccgagatcgtgccattgcactccagcctgggtgacagagcaagactccgtctcaaaaagaaaaaaaaaaaattagccaggcatggtggcaggtgcctgtaatcccagctacttgagaggctgaggcaggagaatcgcttgaacccgggaggtggaggttgtggtgagccgaggtcgcgccactgcactccagcctgggcaacgacaacaacaataaaaagagggggctctgtgcccggcatgtctctgaagactgattgaacctatgcaccagttgttgctttaagtcgctttattttctgtctttggtgtctctggatgtaggagccccctgctttctctgtccgcagaactccatactgggtcccctacgtgttcctccttccctaggacagcaacaaaaacacacaattttccctctctagcaggtctctaagtctcctgattcctgaaactgcctcagactccccctagagggagggaggcccctgaggctttcttgccatcatagcctcttctgggcctcagtttcccctctgtaacctgatcctagtacttggataaactccgacgaggtgtggggggttgttgtctgtgacctccctgaaatatcttagacatttggggtactgagcatttatctggggttaaataaaatctttacatcttaagacattcgattgaccaaattgagtgtcctggccatttcactgatgaggaaactgaggcgcagagaggtcctcttgccagctcaaagtcaagcatctgggcgcccaatgttagccagcggcaccccctggtggcgggcgtgggagacacggcggggcgcgcttgtcgggggttggggggtgggtcggaggggtggcatcctccagccctgatggtcccacttaccgcacctcgccgggaagagctcgtcctgctggtcgggcctccgagcggactgggcagcaccatgctcaagcctagggttcgatccccgcctccggaagcctcagtatccatccctcccctctgcctccctcttcgcgtgcctgaatatttatacaagatacaggcgtcatcacagccgccctcggcttccagagcagctggcttcgttcataaatattataaccactcagaattcatcatcatcacagttaatgataaaattccacagtgccagaactaaaagtcatccgggttcacgaacttggtgcatttccttccagacttttaaaaagaagatatttagggaatttttttttcaagatttttccccccagtccgcttacaaagtaataccatgttcgctgtaaaaaatttggaaataatggaaatgtataaagaaggaaataaaattctgctgtatctccaccca

SEQ ID NO: 22269 - DNA, 5346 bp, Homo sapiens
atgggacccaggcaggactccgcagtggtgcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgtgccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctgggcgacagagcaagacactgtctcaaaaaagaaaagaaaaaaaaaaaagccgggccaggtggctcacgcctgtaatcctagcactttgggaggctgagtgggggtggatcgcctgagatcaggagttcaaaatcagcctggccaacatagtgaaaccctgtctctactaaaaatacaaaaaattagaggctgggtgcggcggctcacacctgtaatcccagaactttgggaggccgaggcgggtggatcacgaggtcaggagttcaagaccagcctggccaacacggtgaaaccccatctctactaaaaatacacaaattagctgggcatggtgttgggtgcctgaatcccagctactcgggaggctgaggcaggagaatcgcttgaatccgggaggcggggcttgcagtgagccgagatcgtgccattgcactccagcctgggtgacagagcaagactccgtctcaaaaagaaaaaaaaaaaattagccaggcatggtggcaggtgcctgtaatcccagctacttgagaggctgaggcaggagaatcgcttgaacccgggaggtggaggttgtggtgagccgaggtcgcgccactgcactccagcctgggcaacgacaacaacaataaaaagagggggctctgtgcccggcatgtctctgaagactgattgaacctatgcaccagttgttgctttaagtcgctttattttctgtctttggtgtctctggatgtaggagccccctgctttctctgtccgcagaactccatactgggtcccctacgtgttcctccttccctaggacagcaacaaaaacacacaattttccctctctagcaggtctctaagtctcctgattcctgaaactgcctcagactccccctagagggagggaggcccctgaggctttcttgccatcatagcctcttctgggcctcagtttcccctctgtaacctgatcctagtacttggataaactccgacgaggtgtggggggttgttgtctgtgacctccctgaaatatcttagacatttggggtactgagcatttatctggggttaaataaaatctttacatcttaagacattcgattgaccaaattgagtgtcctggccatttcactgatgaggaaactgaggcgcagagaggtcctcttgccagctcaaagtcaagcatctgggcgcccaatgttagccagcggcaccccctggtggcgggcgtgggagacacggcggggcgcgcttgtcgggggttggggggtgggtcggaggggtggcatcctccagccctgatggtcccacttaccgcacctcgccgggaagagctcgtcctgctggtcgggcctccgagcggactgggcagcaccatgctcaagcctagggttcgatccccgcctccggaagcctcagtatccatccctcccctctgcctccctcttcgcgtgcctgaatatttatacaagatacaggcgtcatcacagccgccctcggcttccagagcagctggcttcgttcataaatattataaccactcagaattcatcatcatcacagttaatgataaaattccacagtgccagaactaaaagtcatccgggttcacgaacttggtgcatttccttccagacttttaaaaagaagatatttagggaatttttttttcaagatttttccccccagtccgcttacaaagtaataccatgttcgctgtaaaaaatttggaaataatggaaatgtataaagaaggaaataaaattctgctgtatctccaccca

SEQ ID NO: 22270 - DNA, 5124 bp, Homo sapiens
ttcgacgtgatcagacccaactcagacccggtcatacttggaccgaatgctgccaaatcccccacctctacccagatctgagcctacgcggggtgccgacccagctcgtggacggggatacggtgacctttgacccaaaagtcttggccgggaccagccggacactggccctcggccgggagctccgagtctcaggcggtcccggttgtcttcctgtcggtgccgcttccgcctgcccttcttgaaaacccacccccagctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgtgccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctgggcgacagagcaagacactgtctcaaaaaagaaaagaaaaaaaaaaaagccgggccaggtggctcacgcctgtaatcctagcactttgggaggctgagtgggggtggatcgcctgagatcaggagttcaaaatcagcctggccaacatagtgaaaccctgtctctactaaaaatacaaaaaattagaggctgggtgcggcggctcacacctgtaatcccagaactttgggaggccgaggcgggtggatcacgaggtcaggagttcaagaccagcctggccaacacggtgaaaccccatctctactaaaaatacacaaattagctgggcatggtgttgggtgcctgaatcccagctactcgggaggctgaggcaggagaatcgcttgaatccgggaggcggggcttgcagtgagccgagatcgtgccattgcactccagcctgggtgacagagcaagactccgtctcaaaaagaaaaaaaaaaaattagccaggcatggtggcaggtgcctgtaatcccagctacttgagaggctgaggcaggagaatcgcttgaacccgggaggtggaggttgtggtgagccgaggtcgcgccactgcactccagcctgggcaacgacaacaacaataaaaagagggggctctgtgcccggcatgtctctgaagactgattgaacctatgcaccagttgttgctttaagtcgctttattttctgtctttggtgtctctggatgtaggagccccctgctttctctgtccgcagaactccatactgggtcccctacgtgttcctccttccctaggacagcaacaaaaacacacaattttccctctctagcaggtctctaagtctcctgattcctgaaactgcctcagactccccctagagggagggaggcccctgaggctttcttgccatcatagcctcttctgggcctcagtttcccctctgtaacctgatcctagtacttggataaactccgacgaggtgtggggggttgttgtctgtgacctccctgaaatatcttagacatttggggtactgagcatttatctggggttaaataaaatctttacatcttaagacattcgattgaccaaattgagtgtcctggccatttcactgatgaggaaactgaggcgcagagaggtcctcttgccagctcaaagtcaagcatctgggcgcccaatgttagccagcggcaccccctggtggcgggcgtgggagacacggcggggcgcgcttgtcgggggttggggggtgggtcggaggggtggcatcctccagccctgatggtcccacttaccgcacctcgccgggaagagctcgtcctgctggtcgggcctccgagcggactgggcagcaccatgctcaagcctagggttcgatccccgcctccggaagcctcagtatccatccctcccctctgcctccctcttcgcgtgcctgaatatttatacaagatacaggcgtcatcacagccgccctcggcttccagagcagctggcttcgttcataaatattataaccactcagaattcatcatcatcacagttaatgataaaattccacagtgccagaactaaaagtcatccgggttcacgaacttggtgcatttccttccagacttttaaaaagaagatatttagggaatttttttttcaagatttttccccccagtccgcttacaaagtaataccatgttcgctgtaaaaaatttggaaataatggaaatgtataaagaaggaaataaaattctgctgtatctccaccca

SEQ ID NO: 22271 - DNA, 5346 bp, Homo sapiens; identical to SEQ ID NO: 22269

SEQ ID NO: 22272 - DNA, 5071 bp, Homo sapiens
gctgtccagaaaaggtcccgcgcagccggcgctcggtccagcctccacgcagtcctggcgatgcagggcccccccgcgcccgccccggtccccgggcccggctcccctcggggatccccgcgcggctcccccgggctcttcaggaagcttttggtgaatcagagcatccgcctgcagcggcgcttcacggtggcccatccgctgtgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgtgccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctgggcgacagagcaagacactgtctcaaaaaagaaaagaaaaaaaaaaaagccgggccaggtggctcacgcctgtaatcctagcactttgggaggctgagtgggggtggatcgcctgagatcaggagttcaaaatcagcctggccaacatagtgaaaccctgtctctactaaaaatacaaaaaattagaggctgggtgcggcggctcacacctgtaatcccagaactttgggaggccgaggcgggtggatcacgaggtcaggagttcaagaccagcctggccaacacggtgaaaccccatctctactaaaaatacacaaattagctgggcatggtgttgggtgcctgaatcccagctactcgggaggctgaggcaggagaatcgcttgaatccgggaggcggggcttgcagtgagccgagatcgtgccattgcactccagcctgggtgacagagcaagactccgtctcaaaaagaaaaaaaaaaaattagccaggcatggtggcaggtgcctgtaatcccagctacttgagaggctgaggcaggagaatcgcttgaacccgggaggtggaggttgtggtgagccgaggtcgcgccactgcactccagcctgggcaacgacaacaacaataaaaagagggggctctgtgcccggcatgtctctgaagactgattgaacctatgcaccagttgttgctttaagtcgctttattttctgtctttggtgtctctggatgtaggagccccctgctttctctgtccgcagaactccatactgggtcccctacgtgttcctccttccctaggacagcaacaaaaacacacaattttccctctctagcaggtctctaagtctcctgattcctgaaactgcctcagactccccctagagggagggaggcccctgaggctttcttgccatcatagcctcttctgggcctcagtttcccctctgtaacctgatcctagtacttggataaactccgacgaggtgtggggggttgttgtctgtgacctccctgaaatatcttagacatttggggtactgagcatttatctggggttaaataaaatctttacatcttaagacattcgattgaccaaattgagtgtcctggccatttcactgatgaggaaactgaggcgcagagaggtcctcttgccagctcaaagtcaagcatctgggcgcccaatgttagccagcggcaccccctggtggcgggcgtgggagacacggcggggcgcgcttgtcgggggttggggggtgggtcggaggggtggcatcctccagccctgatggtcccacttaccgcacctcgccgggaagagctcgtcctgctggtcgggcctccgagcggactgggcagcaccatgctcaagcctagggttcgatccccgcctccggaagcctcagtatccatccctcccctctgcctccctcttcgcgtgcctgaatatttatacaagatacaggcgtcatcacagccgccctcggcttccagagcagctggcttcgttcataaatattataaccactcagaattcatcatcatcacagttaatgataaaattccacagtgccagaactaaaagtcatccgggttcacgaacttggtgcatttccttccagacttttaaaaagaagatatttagggaatttttttttcaagatttttccccccagtccgcttacaaagtaataccatgttcgctgtaaaaaatttggaaataatggaaatgtataaagaaggaaataaaattctgctgtatctccaccca

SEQ ID NO: 22273 - DNA, 1699 bp, Homo sapiens
gaccgttcggagcaacgtggcggcccttgcccgccagcaatgcctaggagcagccaaaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgctt

SEQ ID NO: 22274 - DNA, 2692 bp, Homo sapiens
aaagctacctttttctctttcaacacggtgcgagggacaccgtctcggccccgggggtctcctgagaccctgtctccctgccctccatttagcagcgatcagtggacaatttctgtcttctccactccaagtccttgtcttggttcttttccatgcagcgctataggggacggcagacggttttcggggctggtgtgttggggggggtctcttcagcccctagcttcaacaccccctcaccacgttcttctcccctgttctacccttcagcaccatctgggcatcgacagctcctcggtgtcggccccaccttgagccccagttccaccttctaccgcttcagcacctccggcgcggacagctcctcgctgtcgcctccactcccggccctgggccggacccgggagcagacgctcctcggcgcccgctcacggggacgagtcctgctccctgctatcccagacccctttctctggcgcatggagaacctgggggtcggcgaaggggcagaggcttgcagcaggttgagtcgctctcgcggccgccacagcatgaccagagccccgaagcacctgtggcggcaaccccggcgccccatccgcatccaacagcgcttctattcggatccggacaagtccgcgggctgccgcgagagggacctgagcccgcggccggagctcaggaagtcgcggctctcctggcccgtttcctcctgcaggcgctttgacctggaaaatgggctctcgtgtgggaggagggccctggaccctcagtccagccctggcctgggccggattatgcaggctccagtcccgcacagccagcggcgcgagtccttcctgtaccgctcagatagcgactatgaactctcgcccaaggccatgtctcggaactcctctgtggccagcgacctacatggagaggacatgattgtgacgccctttgcccaggtcctggccagtctgcggaccgttcggagcaacgtggcggcccttgcccgccagcaatgcctaggagcagccaagcagggacccgtcggaaacccttcatccagcaatcagctccctcctgcagaggacacggggcagaagctggcattggagacgctagacgagctggactggtgcctggatcagttggagacgctgcagacccggcactcggtgggggagatggcctccaacaagttcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccagga

SEQ ID NO: 22275 - DNA, 4525 bp, Homo sapiens
cccctccggatccggcctctccttcccaccgcctaccacctcctcccaacaggtcctggccagtctgcggaccgttcggagcaacgtggcggcccttgcccgccagcaatgcctaggagcagccaattcaagcggatcctgaaccgggagttgacccacctgtccgaaaccagccgctccgggaaccaggtgtccgagtacatctcccggaccttcctggaccagcagaccgaggtggagctgcccaaggtgaccgctgaggaggccccacagcccatgtcccggatcagtggcctacatgggctctgccacagtgccagcctctcctcagccactgtcccacgctttggggtccagactgaccaggaggagcaactggccaaggagctagaagacaccaacaagtggggacttgatgtgttcaaggtggcggagctaagtgggaaccggcccctcacagctatcatattcagcatttttcaggagcgggacctgctgaagacattccagatcccagcagacacactggccacctacctgctgatgctggaaggtcactaccacgccaatgtggcctaccacaacagcctacatgccgccgacgtggcccagtccacgcatgtgctgctggctacgcccgccctcgaggctgtgttcacagacttggaaatcctggctgccctctttgcaagcgccatccacgacgtggaccatcctggggtctccaaccagtttctgattaacaccaactcagagctggcgcttatgtacaacgacgcctcggtgctggagaaccatcacctggctgtgggcttcaagctgctgcaggcagagaactgcgatatcttccagaacctcagcgccaagcagcgactgagtctgcgcaggatggtcattgacatggtgctggccacagacatgtccaaacacatgaacctcctggccgacctcaagaccatggtggagaccaagaaggtgacaagcctcggtgtcctcctcctggacaactattccgaccgaatccaggtcttgcagaacctggtgcactgtgctgatctgagcaaccccaccaagccgctgcccctgtaccgccagtggacggaccgcatcatggccgagttcttccagcagggagaccgcgagcgtgagtcgggcctggacatcagtcccatgtgtgacaagcatacggcctcagtggagaagtcccaggtgggtttcattgactacattgctcacccactgtgggagacttgggctgacctggtccacccagatgcacaggacctgctggacacgctggaggacaatcgagagtggtaccagagcaagatcccccgaagtccctcagacctcaccaaccccgagcgggacgggcctgacagattccagtttgaactgactctggaggaggcagaggaagaggatgaggaggaagaagaggagggggaagagacagctttagccaaagaggccttggagttgcctgacactgaactcctgtcccctgaagccggcccagaccctggggacttacccctcgacaaccagaggacttagggccagccctgcgtgaactgcaggggcaatggatggtaaagccctttggctcttggcaggcagactttccaggaagaggctccatgtggctcctgcttcactttcccacccatttagggagacaatcaagctcttagttataggtggctcccagggtctaattggaggcacctggctggggtccactctgaccctagacttgcctaaaagagctctctaaggggcagcctcttacgatgccctggtgtctttctcctgggcttctatccctgtgaggagaggtgctgtctgctggagcctctagtccaccctctccagtggtcactcttgagtcacatctgtcacttaattatttccttctttatcaaatatttattgctcatctacttcgtgccagctttctgcctctgtagtagccctgcacaaagggtggggagtcaggagaccatcccaaaggcatctccctgtcttcctctaccaagcggctctctgcaagagcatggaaatgtgagtggggaaaattttcagcaccaaagcttcactcatacccagttttgtttctgaaactacggtagggggcaggaagaggagcagaaaagaagggctgggcaaggcatagtggcttatgcctgtaatcccggtactttgggaggctgaggtgggaggactgcttaagctcaggagtttgagaccagcctgggcaacatagcaagacccccaccatctctgaaaaaaaaaattagccaggcatggtggtgtgcacctgagaatcccagctactcagaaggttgagacaaaggggatcgcttgagcccaggagttggaggctgaagagagctatgactgcatcactgcactccagcctgggcaacacagcaagatcctgtctaaaaataaaaagaaaagagaaggaaaggaaagagacggggctctgaggccgagcacagtggcccatgcctataatcccagcactttgggaggctgaggcaggtggatcacctgaggttaggagttcgagaccagcctggccaacatggtgaaaccccatctctactaaaaatacaaaaattggctgggcatggtggcgggtgcctgtaatcccagctactggggaggctgaggcaggagaatcacttgaattcaggaggtggaggttgcagtgagccgacatcatgccactgcactccagcctgggcgacagagcaagacactgtctcaaaaaagaaaagaaaaaaaaaaaagccgggccaggtggctcacgcctgtaatcctagcactttgggaggctgagtgggggtggatcgcctgagatcaggagttcaaaatcagcctggccaacatagtgaaaccctgtctctactaaaaatacaaaaaattagaggctgggtgcggcggctcacacctgtaatcccagaactttgggaggccgaggcgggtggatcacgaggtcaggagttcaagaccagcctggccaacacggtgaaaccccatctctactaaaaatacacaaattagctgggcatggtgttgggtgcctgaatcccagctactcgggaggctgaggcaggagaatcgcttgaatccgggaggcggggcttgcagtgagccgagatcgtgccattgcactccagcctgggtgacagagcaagactccgtctcaaaaagaaaaaaaaaaaattagccaggcatggtggcaggtgcctgtaatcccagctacttgagaggctgaggcaggagaatcgcttgaacccgggaggtggaggttgtggtgagccgaggtcgcgccactgcactccagcctgggcaacgacaacaacaataaaaagagggggctctgtgcccggcatgtctctgaagactgattgaacctatgcaccagttgttgctttaagtcgctttattttctgtctttggtgtctctggatgtaggagccccctgctttctctgtccgcagaactccatactgggtcccctacgtgttcctccttccctaggacagcaacaaaaacacacaattttccctctctagcaggtctctaagtctcctgattcctgaaactgcctcagactccccctagagggagggaggcccctgaggctttcttgccatcatagcctcttctgggcctcagtttcccctctgtaacctgatcctagtacttggataaactccgacgaggtgtggggggttgttgtctgtgacctccctgaaatatcttagacatttggggtactgagcatttatctggggttaaataaaatctttacatcttaagacattcgattgaccaaattgagtgtcctggccatttcactgatgaggaaactgaggcgcagagaggtcctcttgccagctcaaagtcaagcatctgggcgcccaatgttagccagcggcaccccctggtggcgggcgtgggagacacggcggggcgcgcttgtcgggggttggggggtgggtcggaggggtggcatcctccagccctgatggtcccacttaccgcacctcgccgggaagagctcgtcctgctggtcgggcctccgagcggactgggcagcaccatgctcaagcctagggttcgatccccgcctccggaagcctcagtatccatccctcccctctgcctccctcttcgcgtgcctgaatatttatacaagatacaggcgtcatcacagccgccctcggcttccagagcagctggcttcgttcataaatattataaccactcagaattcatcatcatcacagttaatgataaaattccacagtgccagaactaaaagtcatccgggttcacgaacttggtgcatttccttccagacttttaaaaagaagatatttagggaatttttttttcaagatttttccccccagtccgcttacaaagtaataccatgttcgctgtaaaaaatttggaaataatggaaatgtataaagaaggaaataaaattctgctgtatctccaccca

SEQ ID NO: 22276 - DNA, 8150 bp, Homo sapiens
gctcgcggttgacagctcagctggtgccgagcaactcgtgccagccagtcgtgtctcagcctggagagtgcgcgcaccgccgcccgggcagccgctggctccagctcacgaaacagccccgggcgccgcgccgctctgagtccagcctcctactgagaacagtccctcccttgtgcgggtcgcacggctagccgcaggttcggccacgtcaaatccattttctaaaaaagcagggagcagagctctctcttcgccgccgacgcagaaaggagctggggaggaaaaagctgctgccttttgcgctggagattcgtgggcaaggcttctcattttcccaggctgcttcccctcccgggtgaggagcgtcctgagactaaggaaagagcctggaaaatggagcagacctggacgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgagttggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccctggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttcactg

SEQ ID NO: 22277 - DNA, 5676 bp, Homo sapiens
ggatccttgagggcactggtgcgactttcaggtgaggtcttagcagatgaaagcggctggctgtggcccgcgccagtagtgctttctgctccgcactcgccgtgagccaggtgtgcaaccggatttggggcgagggtcgcgctggctacctcgcatgcgcagagccggaagcccgctgaccggactacagctcccagaagagccttgtggaggccgcagacgcgaagccgctggcgccatcttgaaatctgatcctccatccccgaggctttgcgtctgcgcggccggccgctgctgctccgggagcccagtctgctaaaaggggaggacgttgaggacgcggcggctggcgggagagacagctggggagagacatggcagggtcggagcgcggcctgcgcctctgtcactcagcatcctcttaggcgtttccacgcccgccccctgcccgaggggcggggctgacggctctggtacccggagtcggcgcgcggggcaggggcgcgcccctgcagagtggggaccccactgggctgtgccatgctgaccggagaccaccgaggcgggagacagagcgcggcgaagagccattgagtggtcacccagtagccgccgccgccgccgcctcgggaagcttgccacccgctaggagggaagatgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaactatagcttcagaagcatttttacttgcaagacgatggacacattccccttgggctttttgtaactgaaacgcaccacagaagacagggagtcatcgaagggctgctcggggaggtggcagggcggaggacctgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagcactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagacaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccat

SEQ ID NO: 22278 - DNA, 1137 bp, Homo sapiens
ccagtcccgagtcccggagagagctccagcaataggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatagattcacttattcagcaaacatttactgggcatgccacatgccagataccgggctaagtatctggcatgtgttacagaaacaaaagacctaattcttgtcaccaagaaacatgttacatgattttaataagttccctgatagaagagcatggggtgctctggggaaatattggagggtcatccattccacattaaaagagcaagttgtctgct

SEQ ID NO: 22279 - DNA, 1690 bp, Homo sapiens
aaacttatctgaggttggaaataaagagaaggtgacattggagcggatagaaaggaagaaacggcgtgggatctgggaatgaggcagtgggtggagagagaatggggagacgacagaggatgaagggcagctgagtgtgtctgcgggagaaggaccaaagcaatctgggcggagcaggtggcagaggcagccgcggaggaggcccagggaactgacggggatgctcagccaggcccagaggatgcgccctggcagtcccggaagacaccaggaaaacaagcaggaaccgtagctaggactggggtggccaggcccaggaaatccatgaagggcacagacagcgggtcctgctgccgccgccgatgcgactttggctgctgctgtcgcgcgtcccgccgggctcactacacgccttaccggtccggggacgcgacgcgaacccctcagtccccacggcagaccccgagccgggaaagacggcgcccggagccagccgggagctgggcagcagcggccgaggaggaagaagcagctgcggcggccacaccctggatgagagattattttgcagaggatgatggggagatggtacccagaacgagtcacacagcagcttttcttagtgacactaaagatcgaggccctccagtgcagtcacagatctggagaagtggtgaaaaggtcccgtttgtgcagacatattccttgagagcatttgagaaaccccctcaggtacagacccaggctcttcgagactttgagaagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagtaggtgccttcggtgctctttttgtcgcttgtcttttgcccattctcaaggcatacagcagctgtcctgttccctttcaaggactgacagtaggagcttcactatttctaagactttatgggcccacaaccgaagacattcttttcagggttgaattttcagtggtatccattatgaaaactcacttcatggattcagtgggcaaatagcggcaagcaagagacatagattcacttattcagcaaacatttactgggcatgccacatgccagataccgggctaagtatctggcatgtgttacagaaacaaaagacctaattcttgtcaccaagaaacatgttacatgattttaataagttccctgatagaagagcatggggtgctctggggaaatattggagggtcatccattccacattaaaagagcaagttgtc

SEQ ID NO: 22280 - DNA, 4677 bp, Homo sapiens
aggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaactatagcttcagaagcatttttacttgcaagacgatggacacattccccttgggctttttgtaactgaaacgcaccacagaagacagggagtcatcgaagggctgctcggggaggtggcagggcggaggacctgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagcactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagacaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataa

SEQ ID NO: 22281 - DNA, 4922 bp, Homo sapiens
gcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaagtaagtcagtgtcagggtctgggacttccagggtggacagcacacagcccttctgaggtctgatagtctcctgcagcccttgcggacttagtgagaagatatctttttacataaactacttctcagtcatcttcctgttctccttgaacttcccagctgcctttccaacccatatcttcactccatttttctctccaatccaccctttggtttgtattgtatctctttcttctgcttccttccccctcctacccacctttgcccctatttattctctgtagctatagcttcagaagcatttttacttgcaagacgatggacacattccccttgggctttttgtaactgaaacgcaccacagaagacagggagtcatcgaagggctgctcggggaggtggcagggcggaggacctgcttgggaagaaactccaagaagattggaatgcttccaaagcaagaatctttctcagtgaaatctcattatacaaagagaaccttatgcaacctgacaaaccactgaggtcatggtgactcagtgatcagcagatggtacttcaacagcaatcccctgtcaaacctcagaacttgaggctgaaacattgcttccacccaccatcagtgaagatgtaactagcatgttacaagagtgaataatctggacttcagagattaagtcaccaatagtgatctcacaagcactcaccggaactcctataatgtctccactttgtccatgccatttagcaatctcatctcctaaatggactgtgcctatgattcttaaggagaaagtgaatcattggtagatatcctgcacaagcagctggactttccagtaatagctttcttggggctattaggaaaattaaacaagaaatgaggctttctgggtctgcctgtatgtcttctgcataagacaaagaagagacatcgaatcaaccaataagaagagcccaaataagcatcctcaaatcttttgggatttggcacttggggacatgagtagttgtctgggatacgtcatattctcaacagtttctttgtagtagtaggatcaccttcttataataggatcaccttcttgttgctatagctgtacccgaccttcccttctcccttgagtgcttgcatgagctccacttttccttttgcttgaacagcttctcctgagtcctccttaccgatggttgtgactttaattatatacatctctgtccctccagacagatccctctgtcctcactctctgatttcattgaggatcttgggtgagagagagggacctgcaggatgaacaaatgtctactctaagacagctagattgggaggttggctggtcactgatggttataatgactgtgggacaggattaacttcagaataaatgaacaggagacacagatatgaagaaagtttctgattgatatggtctgaagtactcctggtattgcaagtcatttgctctaattctcaattgtaggcaaactgatttgtaaatttgcttcttcagccttctttcctgtagcctagcatggagaatctgaccagaccccattttgagaaggtcagcctacactggaatgaactttttacattagggcatttgtatttccctcacaatacttgccacattacttggcataggagagatgcttagtgtaattataagttaacaagcctttggatcagggcttgactcatgatagacaaagtatatgcctgctggatggaagaatctcttgggcgagcaccatttttctttccatcacctttccttgaaaatatatcttcagctttgggtaggaggaatcttggtgtatgaaatcattgcaaatttacttcatcttttctggagtttgaagttgtgactctcctgctaccaattaaataaagcttactttgccataa

SEQ ID NO: 22282 - DNA, 8560 bp, Homo sapiens
atgaaggagatttgcaggatctgtgcccgagagctgtgtggaaaccagcggcgctggatcttccacacggcgtccaagctcaatctccaggttctgctttcgcacgtcttgggcaaggatgtcccccgcgatggcaaagccgagttcgcttgcagcaagtgtgctttcatgcttgatcgaatctatcgattcgacacagttattgcccggattgaagcgctttctattgagcgcttgcaaaagctgctactggagaaggatcgcctcaagttctgcattgccagtatgtatcggaagaataacgatgactctggcgcggagatcaaggcggggaatgggacggttgacatgtccgtcttacccgatgcgagatactctgcactgctccaggaggacttcgcctattcagggtttgagtgctgggtggagaatgaggatcagatccaggagccacacagctgccatggttcagaaggccctggaaaccgacccaggagatgccgtggttgtgccgctttgcgggttgctgattctgactatgaagccatttgtaaggtacctcgaaaggtggccagaagtatctcctgcggcccttctagcaggtggtcgaccagcatttgcactgaagaaccagcgttgtctgaggttgggccacccgacttagcaagcacaaaggtacccccagatggagaaagcatggaggaagagacgcctggttcctctgtggaatctttggatgcaagcgtccaggctagccctccacaacagaaagatgaggagactgagagaagtgcaaaggaacttggaaagtgtgactgttgttcagatgatcaggctccgcagcatgggtgtaatcacaagctggaattagctcttagcatgattaaaggtcttgattataagcccatccagagcccccgagggagcaggcttccgattccagtgaaatccagcctacctggagccaagcctggccctagcatgacagatggagttagttccggtttccttaacaggtctttgaaacccctttacaagacacctgtgagttatcccttggagctttcagacctgcaggagctgtgggatgatctctgtgaagattatttgccgctccgggtccagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccctggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttc

SEQ ID NO: 22283 - DNA, 8262 bp, Homo sapiens
agagcagtgagcccagtcccgagtcccggagagagctccagcaataggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccctggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggtgaaatccctaagggctctgccatgtactccagccttgtgacccttgccttccaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 22284 - DNA, 8307 bp, Homo sapiens
acaccacttgtgtctgagttcacgcagcatgttcctctgtcagggattccgcaaatatctccctgaggtaaaaaaggaaagtgtgctgcgctccagcacccagagcagtgagcccagtcccgagtcccggagagagctccagcaataggggccatgtcgccgtagccccagcctctcggtccgcagcctcagcagcgtcccagccggctggcttcatgctgcggtgcagctgcaccatgttcctgggttgagggggcaatcgggcacgctcctccccatgggttgcccatcatgtctaatggatatcgcactctgtcccagcacctcaatgacctgaagaaggagaacttcagcctcaagctgcgcatctacttcctggaggagcgcatgcaacagaagtatgaggccagccgggaggacatctacaagcggaacattgagctgaaggttgaagtggagagcttgaaacgagaactccaggacaagaaacagcatctggataaaacatgggctgatgtggagaatctcaacagtcagaatgaagctgagctccgacgccagtttgaggagcgacagcaggagacggagcatgtttatgagctcttggagaataagatccagcttctgcaggaggaatccaggctagcaaagaatgaagctgcgcggatggcagctctggtggaagcagagaaggagtgtaacctggagctctcagagaaactgaagggagtcaccaaaaactgggaagatgtaccaggagaccaggtcaagcccgaccaatacactgaggccctggcccagagggacaagagaattgaagaactgaatcagagcctggctgcccaggagaggcttgtagaacagctatctcgggagaaacaacaactgctacatctgttggaggagccaactagcatggaagtgcagcccatgactgaagagttgctgaaacaacaaaagctgaattcacatgagaccactataactcagcagtctgtatctgattcccacttggcagaactccaggaaaaaatccagcaaacagaggccaccaacaagattcttcaagagaaacttaatgaaatgagctatgaactaaagtgtgctcaggagtcgtctcaaaagcaagatggtacaattcagaacctcaaggaaactctgaaaagcagggaacgtgagactgaggagttgtaccaggtaattgaaggtcaaaatgacacaatggcaaagcttcgagaaatgctgcaccaaagccagcttggacaacttcacagctcagagggtacttctccagctcagcaacaggtagctctgcttgatcttcagagtgctttattctgcagccaacttgaaatacagaagctccagagggtggtacgacagaaagagcgccaactggctgatgccaaacaatgtgtgcaatttgtagaggctgcagcacacgagagtgaacagcagaaagaggcttcttggaaacataaccaggaattgcgaaaagccttgcagcagctacaagaagaattgcagaataagagccaacagcttcgtgcctgggaggctgaaaaatacaatgagattcgaacccaggaacaaaacatccagcacctaaaccatagtctgagtcacaaggagcagttgcttcaggaatttcgggagctcctacagtatcgagataactcagacaaaacccttgaagcaaatgaaatgttgcttgagaaacttcgccagcgaatacatgataaagctgttgctctggagcgggctatagatgaaaaattctctgctctagaagagaaagaaaaagaactgcgccagcttcgtcttgctgtgagagagcgagatcatgacttagagagactgcgcgatgtcctctcctccaatgaagctactatgcaaagtatggagagtctcctgagggccaaaggcctggaagtggaacagttatctactacctgtcaaaacctccagtggctgaaagaagaaatggaaaccaaatttagccgttggcagaaggaacaagagagtatcattcagcagttacagacgtctcttcatgataggaacaaagaagtggaggatcttagtgcaacactgctctgcaaacttggaccagggcagagtgagatagcagaggagctgtgccagcgtctacagcgaaaggaaaggatgctgcaggaccttctaagtgatcgaaataaacaagtgctggaacatgaaatggagattcaaggcctgcttcagtctgtgagcaccagggagcaggaaagccaagctgctgcagagaagttggtgcaagccttaatggaaagaaattcagaattacaggccctgcgccaatatttaggagggagagactccctgatgtcccaagcacccatctctaaccaacaagctgaagttacccccactggctgtcttggaaaacagactgatcaaggttcaatgcagataccttccagagatgatagcacttcattgactgccaaagaggatgtcagcatacccagatccacattaggagacttggacacagttgcagggctggaaaaagaactgagtaatgccaaagaggaacttgaactcatggctaaaaaagaaagagaaagtcagatggaactttctgctctacagtccatgatggctgtgcaggaagaagagctgcaggtgcaggctgctgatatggagtctctgaccaggaacatacagattaaagaagatctcataaaggacctgcaaatgcaactggttgatcctgaagacataccagctatggaacgcctgacccaggaagtcttacttcttcgggaaaaagttgcttcagtagaatcccagggtcaagaaatttcaggaaaccgaagacaacagttgctgctgatgctagaaggactagtagatgaacggagtcggctcaatgaggccttacaagcagagagacagctctatagcagtctggtgaagttccatgcccatccagagagctctgagagagaccgaactctgcaggtggaactggaaggggctcaggtgttacgcagtcggctagaagaagttcttggaagaagcttggagcgcttaaacaggctggagaccctggccgccattggaggtgcagctgcaggggatgacaccgaagatacaagcactgagttcactgacagtattgaggaggaggctgcacaccatagtcaccagcaacttgtcaaggtggctttggagaaaagtctggcaactgtggagacccagaacccatctttttcccctccttctccgatgggaggggacagtaacaggtgtcttcaggaagaaatgctccacctgagggctgagttccaccagcacttagaagagaagaggaaagctgaggaggaactgaaggagctaaaggctcaaattgaggaagcaggattctcctcagtgtcccacatcaggaacaccatgctgagcctttgccttgagaatgcggagctgaaagagcagatgggagaagcaatgtctgatggatgggagatcgaggaagacaaggagaagggcgaggtgatggttgagactgtggtaaccaaagagggtctgagtgagagtagccttcaggctgagttcagaaagctccagggaaaactgaagaatgcccacaatatcatcaacctcctcaaagaacaacttgtgctgagtagcaaggaagggaatagtaaacttactccagagctccttgtgcatctgaccagcaccattgaaagaataaacacagaactggttggttcccctgggaagcaccaacaccaagaggaggggaatgtgactgtgaggcctttccccagaccccagagccttgaccttggggctaccttcacagtggatgcccaccaattggataaccagtcccagcctcgtgaccctgggcctcagtcagcgtttagcctaccagggtccacccagcacctgcgctcccagctgtcacaatgcaaacaacgctatcaagatctccaggagaagctgctgctatcagaagccactgtctttgctcaggctaacgagctggagaaatacagagttatgcttacaggtgaatccttggtgaagcaggacagcaagcagatccaggtggacctccaggacctgggctatgagacttgtggccgaagcgagaatgaggctgaacgggaggaaaccaccagtcctgagtgtgaggagcacaacagcctcaaggaaatggtcctgatggaggggctgtgctctgagcagggacgccggggctcaacactggctagttcctctgagaggaagcccttggagaaccagctagggaagcaggaagagttccgggtatatggaaagtcagaaaacatcttggtcctacgaaaggacatcaaagatctgaaggcccagctgcagaatgccaacaaggtcattcaaaacctcaagagccgggtccggtccctctcagttacaagtgattattcgtctagtctggaaagaccctggaagctgagagctgttggcaccttggaggggtcttcacctcatagtgtccctgatgaggatgaggggtggctgtctgatggcactggggctttctactctccagggcttcaggccaaaaaggacctggagagtctcatccagagagtatcccagctggaggcccagctcccaaaaaatggactagaagagaagctggctgaggagctgagatcagcctcgtggcctgggaaatatgattccctgattcaggatcaggcccgggaactgtcttacctacggcaaaaaatacgagaagggagaggtatttgttatcttatcacccggcatgcaaaagatacagtaaaatcttttgaggatctcctaaggagcaatgacattgactactacctgggacagagcttccgggagcaactcgcccagggaagccagctgacagagaggctcaccagcaaactcagcaccaaggatcataaaagtgagaaagatcaagctggacttgagccactggccctcaggctcagcagggagctgcaggagaaggagaaagtgattgaagtcctgcaggccaagctggatgctcggtccctcacaccctccagcagccatgccttgtctgactcccaccgctctcccagcagcacctctttcctgtctgatgaactggaagcctgctctgacatggacatagtcagcgagtacacacactatgaagagaagaaagcttctcccagtcactcagattccatccatcattcgagtcattctgctgtgttgtcttctaaaccatcatcaaccagtgcatctcagggggctaaggccgaatccaacagcaaccccatcagcttgccaactccccagaatacccccaaggaggccaaccaggcccattcaggctttcattttcactccatacccaagctggctagccttcctcaggcaccattgccctcagctccatccagcttcctgcctttcagccccactggccctctcctccttggctgctgtgagacaccagtggtctccttggctgaggctcagcaggagctacagatgctgcagaagcagttgggagaaagtgccagcactgttcctcctgcttccacagctacattgctgagcaacgacttggaagccgactcttcctactacctcaactctgcccagcctcactctcctccaaggggcaccatagaactgggaagaatcctagagcctgggtacctgggcagcagtggcaagtgggatgtgatgaggcctcagaaagggagtgtatctggggacctatcctcaggctcctctgtgtaccagcttaactccaaacccacaggggctgacctgctggaagagcatcttggtgaaatccggaacctgcgccagcgcctggaggaatccatctgcatcaatgaccgcctacgggagcaactggaacaccggctgacctctactgctcgtggaaggggatccacttctaacttctacagtcagggcctggagtccatacctcagctctgcaatgagaacagagtcctcagggaagacaatcgaagacttcaggctcaactgagtcatgtttccagagagcactcccaggaaacagaaagcctgagggaggctctgctgtcctctcgatcccaccttcaagagctggaaaaggagctggagcaccagaaggtggaaaggcagcagcttttggaagacttgagggagaagcagcaagaggtcttgcatttcagggaggaacgtctttccctccaggaaaacgactccagactgcagcacaagctggttctcctgcagcaacagtgtgaagagaaacagcagctctttgagtccctccagtcagagctacaaatctacgaggcactttatggcaattccaagaaggggctgaaagcttacagcctggatgcctgtcaccaaatccctttgagcagtgacctgagccacctggtggcagaggtacgagctctgagagggcagctggagcagagcattcaggggaacaattgtctgcgactgcagctgcaacagcagctggagagcggtgctggcaaagccagcctcagcccctcctccattaaccagaacttcccagccagcactgaccctggaaacaagcagctgctcctccaagattcagctgtgtcccctccagtccgggatgttggtatgaattccccagctctggtcttccccagctctgcttcctctactcctggctcagaaacgcccataatcaacagagcaaatggcttgggtttggatacttctccagtaatgaagacccctcccaagctagagggtgatgctactgatggctcctttgccaataagcatggccgccatgtcattggccacattgatgactacagtgccctaagacagcagattgcggagggcaagctgctggtcaaaaagatagtgtctcttgtgagatcagcgtgcagcttccctggccttgaagcccaaggcacagaggtgctaggcagcaaaggtattcatgagcttcggagcagcaccagtgccctgcaccatgccctagaggagtcagcttccctcctcaccatgttctggagagcggccctgccaagcacccacatccctgtgctgcctggcaaagtgggagaatcaacagaaagggaacttctggaactgagaaccaaagtatccaaacaggagcgactccttcagagcacaactgagcatctgaagaacgccaaccagcagaaggagagcatggaacagttcattgtcagccagctaaccagaacacatgatgttttaaagaaggcaaggactaacttagaggaaccatgcaagaagcgcagccaccagaagtccttaaaacagcaggaaaggtgggcctgtcccccttttgtgcagctacctatctgctgaggagcatctgggcctcattcctccaagtccacgggagggtccagaagagggagtcagagatgtatcctggtggagctgggagaaaggcagaaagcctttctgacggctatggaatacgattagccaaggtccacttggcccagcactaagaaaaagatgcgtagtttgcacagaaggttttgtgatcctgcctctcaacagccccagcagcttgggaactagcaagagcacatttcttgcctcatcagctgtcctgagatggaaaactcagtgaatataggaccctgattccgatgaaaggggcacgtggtcccaatgctggagctcctctggcaggttctaaaagcacactactgagcagcggtgccctgccggacactgctggcgggggctcagtgagcactactcacagatccacacctgaccctgttgggtcgagtcaggctgggccttggtctgcactgtagcacctgtgttctttgagttcacatcatgaatgtggtgacttcccagataccatctcaggcttaacctagcacatcctatttcttttcttctatgatatccaaattggactgacctcacttcaaagttgctgtcccattttgtcaccctatcttatctcggggaaattgcagactgatggccagaccaactctgttgaaattcttgcatagagcaaacctgtgctcatttttaagtggcatgggagaggccccaagcctagtaaagcctagtctgtgtcttcacagtgctggtagaatgtgtttgtgtgtataaatatatgatatagatttatatatgttgctaacgccatatattgaaggccaacataactggtggacagggtgggtgacagaaaatgaaagtctttttggtgattgttaaagcaagatgtgtataaagaaataaatagtttttctttca

SEQ ID NO: 22285 - DNA, 2599 bp, Homo sapiens
agttccttatttggtagcttttgacaggactagcctttcttgcaactaagcatcttgacatacattattcattaagccctggagctcgggagagaaagatgcagacccttagatctttagatattcctttatcacgtggattttctttattcagaatagttgctgaattttgtgccattctggagtcttacaaatggcatgtattcgatgggaagacggctggatgggatttaatgcgaggctttcttatgtatacttaattaccaaaaatctttaaaaactcatactctgcgtggcttgtggaggttgttaaagtgtcgagattttgaagctaaatacattttagagcttactatatatatacatatatatatatatacatataatcaatcaaaaatgcctgaagcaaactatttactgtcagtgtcttggggctacataaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaa

SEQ ID NO: 22286 - DNA, 8232 bp, Homo sapiens
gggccccctctcggtagccctgaggctctggcgccttcaagtgagaagctaagcaccagcctctgctgggctgcagaagcggcggcggcggcagcagcagcagcagcatcaggaaggcgctcgggccagcgcggtgaacccgggctgggcagcaggtcgcggagccgcgagccaggatggaggcagagggcagcagcgcgccggcccgggcgggcagcggagagggcagcgacagcgccggcggggccacgctcaaagcccccaagcatctctggaggcacgagcagcaccaccagtacccgctccggcagccccagttccgcctcctgcatccccatcaccacctgcccccgccgccgccaccctcgccccagccccagccccagtgtccgctacagccgccgccgccgccccccctgccgccgcccccgccgccgcccggggctgcccgcggccgctacgcctcgagcggggccaccggccgcgtccggcatcgcggctactcggacaccgagcgctacctgtactgtcgcgccatggaccgcacctcctacgcggtggagaccggccaccggcccggcctgaagaaatccaggatgtcctggccctcctcgttccagggactcaggcgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgataccataaaaa

SEQ ID NO: 22287 - DNA, 7690 bp, Homo sapiens
ggaaaatattaatgacagcaaaacttgaattcacatgtttatttattctttcaacaagtttttctttaaaaccacacactgctgggctatcataagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatacttttatgtgtgttatatcaaatgtgtcttaagcttcatgcaaactcagtcatcagttcgtgttgtctgaagcaagtgggagatatataaatacccagtagctaaaatggtcagtcttttttagatgttttcctacttagtatctcctaataacgttttgctgtgtcactagatgttcatttcacaagtgcatgtctttctaataatccacacatttcatgctctaataatccacacatttcatgctcatttttattgtttttacagccagttatagtaagaaaaaggtttttccccttgtgctgctttataatttagcgtgtgtctgaaccttatccatgtttgctagatgaggtcttgtcaaatatatcactaccattgtcaccggtgaaaagaaacaggtagttaagttagggttaacattcatttcaaccacgaggttgtatatcatgactagcttttactcttggtttacagagaaaagttaaacagccaactaggcagtttttaagaatattaacaatatattaacaaacaccaatacaactaatcctatttggttttaatgatttcaccatgggattaagaactatatcaggaacatccctgagaaacggttttaagtgtagcaactactcttccttaatggacagccacataacgtgtaggaagtcctttatcacttatcctcgatccataagcatatcttgcagaggggaactacttctttaaacacatggagggaaagaagatgatgccactggcaccagagggttagtactgtgatgcatcctaaaatatttattatattggtaaaaattctggttaaataaaaaattagagatcactcttggctgatttcagcaccaggaactgtattacagttttagagattaattcctagtgtttacctgattatagcagttggcatcatggggcatttaattctgactttatccccacgtcagccttaataaagtcttctttaccttctctatgaagactttaaagcccaaataatcatttttcacattgatattcaagaattgagatagatagaagccaaagtgggtatctgacaagtggaaaatcaaacgtttaagaagaattacaactctgaaaagcatttatatgtggaacttctcaaggagcctcctggggactggaaagtaagtcatcagccaggcaaatgactcatgctgaagagagtccccatttcagtcccctgagatctagctgatgcttagatcctttgaaataaaaattatgtctttataactctgatcttttacataaagcagaagaggaatcaactagttaattgcaaggtttctactctgtttcctctgtaaagatcagatggtaatctttcaaataagaaaaaaataaagacgtatgtttgaccaagtagtttcacaagaatatttgggaacttgtttcttttaattttatttgtccctgagtgaagtctagaaagaaaggtaaagagtctagagtttattcctctttccaaaacattctcattcctctcctccctacacttagtatttcccccacagagtgcctagaatcttaataatgaataaaataaaaagcagcaatatgtcattaacaaatccagacctgaaagggtaaagggtttataactgcactaataaagagaggctctttttttttcttccagtttgttggtttttaatggtaccgtgttgtaaagatacccactaatggacaatcaaattgcagaaaaggctcaatatccaagagacagggactaatgcactgtacaatctgcttatccttgcccttctctcttgccaaagtgtgcttcagaaatatatactgctttaaaaaagaataaaagaatatccttttacaagtggctttacatttcctaaaatgccataagaaaatgcaatatctgggtactgtatggggaaaaaaatgtccaagtttgtgtaaaaccagtgcatttcagcttgcaagttactgaacacaataatgctgttttaattttgttttatatcagttaaaattcacaataatgtagatagaacaaattacagacaaggaaagaaaaaacttgaatgaaatggattttacagaaagctttatgataatttttgaatgcattatttattttttgtgccatgcattttttttctcaccaaatgaccttacctgtaatacagtcttgtttgtctgtttacaaccatgtatttattgcaatgtacatactgtaatgttaattgtaaattatctgttcttattaaaacatcatcccatgatgggatggtgttgatatatttggaaactcttggtgagagaatgaatggtgtgtatacatactctgtacatttttcttttctcctgtaatatagtcttgtcaccttagagcttgtttatggaagattcaagaaaactataaaatacttaaagatatataaatttaaaaaaacatagctgcaggtctttggtcccagggctgtgccttaactttaaccaatattttcttctgttttgctgcatttgaaaggtaacagtggagctagggctgggcattttacatccaggcttttaattgattagaattctgccaataggtggattttacaaaaccacagacaacctctgaaagattctgagacccttttgagacagaagctcttaagtacttcttgccagggagcagcactgcatgtgtgatggttgtttgccatctgttgatcaggaactacttcagctacttgcatttgattatttcctttttttttttttttaactcggaaacacaactggggaaatatattctttcccagtgattataaacaatctttttcttttttttaagtccttttggcttctagagctcataggaaaatggacttgatttgaaattggagccagagtttactcgtgttggttatctattcatcagcttcctgacatgttaagagaatacattaaagagaaaatactgttttttaatcctaaaatttttcttccactaagataaaccaaatgtccttacatatatgtaaacccatctatttaaacgcaaaggtgggttgatgtcagtttacatagcagaaagcattcactatcctctaagatttgtttctgcaaaactttcattgctttagaattttaaaatttcaccttgtacaatggccagcccctaaagcaggaaacatttataatggattatatggaaacatcctcccagtacttgcccagcccttgaatcatgtggcttttcagtgaaaggaaagattctttttctaggaaaaatgagcctattttattttattttattttattttttgacacaaactgtagattttagcagccctggcccaaaggaatttgattacttttgttttaaacagtacaaaggggacactataattacaaaaacatccttaactgatttgagttgtttttatttctttggatatattttcagagtggtaaattgtgtgtgagaattacaaatgattattcttttagtggtttcttagcctctcttacagcccacggggatagtactgtacatcaataccttcatatgaaatttttatatgcaatgaaaataaaagcatgggttgattctgcctatttatgactcaatcttttacaaataaaagattattcattttaaattatagttcaatcagcatgtctcttaggatactgaacgtggttgaaatgaaaggatagtgacatcataagttagtactgatattcataaccaaataaagccaacttgagtaattttgctacattaaaaattaccaaaattacttagatggcctataagattaagcatggtgttttctaagcaagctttgaaaggggccttccatacttacttaattgaatattctgggatattgaaaattattcagatacttgacaattatttttggttacctactccgcaaactacaaagttttaaggactcaacaataagttaatgagacacagtgtttgctttcatggagcttacagtctggaggggacaaaggcttaaacaatactcatataattatatatgtgatcagtacaatgaaggagctcagtggggtaaataagcaggaacctgaacttgatctgttccggagggccacagaaggcttccttgaggccttgagaaagtgatttgcatctgagttctgaaggattgtaagaggtaactagggaaaaagttgacaggaagaggaaggggatccagacaagaaacatttgcaaagatcttgaggcataaatgagcttgagacatctggagaaactgaggaaaagtgagagagtaggcagggcctggagccgcagagccattgctaaccatcctgtgtgagatatcccccattctgtagctttattctcataaccctgctcaattttctttataacacttctcacagatttatatacgtgtttgtttttgttatctgtctctcccaccagaccacagctccatgagagcaaggtctttgcttaccaatatatcactagcacttaaaactatgcctggtacacagtaggttcttaatatgtgttgaatatagccatcaaattgatattggatataattcaatctgataagatattttgagatattaaagagtttttaacttgatacc

SEQ ID NO: 22288 - DNA, 2969 bp, Homo sapiens
gtggtggccgcgcacccggccgcggctgattcattcacttcaagtgccgtgcagaaggctcggcaggcggggcgggcgtggggccgcggctccgggttggggaccgaggagatccggctgtggaccagacgctcctctgcggggcgggcacccaagcgcgctcgccaccccctcgccatccgctagagccgggctcctggactgggactcgggcccgccgcacagttgaaaagtcgcatagtggtttttccgctcgcgtcgctgtgtgaaagttggctcgccgctctttgcacgccctccctggaggccgacccgagacgccaagctggagagaccgtgcctccccgaggccggccgccccgcgagcacagcctccgcccccgttgcactgccgggctgggcaatatgaaggagcagccctcatgtgccggcaccgggcatccgagcatggcgggaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcatt

SEQ ID NO: 22289 - DNA, 3122 bp, Homo sapiens
caatacttgttgcaataattgcccacgatagctgctcaaacaagagagttggaattcatctgtaaaaatcactacatgtaacgtaggagacaagaaaaatattaatgacagaagatctgcgaacatgatgcacgtgaataattttccctttagaaggcattcctggatatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatac

SEQ ID NO: 22290 - DNA, 2294 bp, Homo sapiens
actgcacaaaggaaatgccctcactcagctacaagtgcctcctgctccgtgcggggcctcagggccccagagccccgcaccagctctgacttctcgtggttcctggggatcttggcatcgtccttaaaaatggcttttgtttgggatcctctgggagccacggtgccaggaccatctacaagagccaaatcaagattgcgtttctcaaagtcctacagttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctg

SEQ ID NO: 22291 - DNA, 2478 bp, Homo sapiens
aagcacgagtcctatagttggcgtaccctgaggcctgccagttcctgccttaatgcatatgtagtcgtaattgagttctgacacggccttggatgtttctgtcctaaatagctgacattgcatcttcaagactgtcattccagttggcttttgagtggatacgtgcagtgagatcattgacactggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtggttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgca

SEQ ID NO: 22292 - DNA, 1040 bp, Homo sapiens
gaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacaggatcctggatggaattgaacccatatacgttacttgacatgtgaaacacgtgtgaccctggcagatgatttggctgaccttgaaaactacagctgtttagtcactttgaaaacaatgcaatacaagtgatttactaggcttcagttttaaccattttatgctgactggtggaaattctaacccttcagaaagaaaaaaaaattgtgaagcaatggaaatgtaccatcctgggtattaatgtcattaattttcaatacattttctcacaaaaagtataaagaagtctttgcttgacct

SEQ ID NO: 22293 - DNA, 2860 bp, Homo sapiens
ttctcactgccctgcggtgttttgaactgccttcttacagacgtcatacagcccttgaggaatagtttctgcctggtgagattgaatgatagttctcattcacaaaaccctggattctaagcagggacacacagaaattactttcgcaggtaaatcagcccacccagccaaagtgtggagagatttgttccttggctgacttctttgctccacggagaggagtgttttcctgtgcttgccctgaaatggaacttccttgacagctctcccgtgttacagtacctcccggtcattttctttttctctctctctacctgcgctcttcgagtgtcagaaacctttaaagctgttactatggaattgcaaaaaagagatcaagtgactctttcactatgctggtttcccttgtgacccagatgaagaatcaattcagaattcagttcctcccttggcattgcaagacacagaagaaactgtcacttcctaacagcctagtactggagtaaattcagtatgaaggaagaaagcgctcctgcgtgttagaaccttgcccatgagctggaccgaggacaggagatggactccaggaaaattggatttcttcaagcagcctcccttggaaatggaatatctttaaaatcttctttgcagaaagacagttagaatgtattaatcagaatagttgaagacttattttcctttttattttttttcaaaatgagcattattatgaagccaagatcccgatctacaagttccctaaggactgcagaggcagtttgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgcc

SEQ ID NO: 22294 - DNA, 1430 bp, Homo sapiens
gacagaagatctgcgaacatgatgcacgtgaataattttccctttagaaggcattcctggatatgaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagagg

SEQ ID NO: 22295 - DNA, 577 bp, Homo sapiens
atagttggcgtaccctgaggcctgccagttcctgccttaatgcatatgtagtcgtaattgagttctgacacggccttggatgtttctgtcctaaatagctgacattgcatcttcaagactgtggtctagctgtgtcccagagagcaacttcccttttcaaggcagcccactctgtgtgatgctttttcctaggtatgggcaacccatccctcctagggtgaaaacttcgctgttgctagttccagcattccagttggcttttgagtggatacgtgcagtgagatcattgacactggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctg

SEQ ID NO: 22296 - DNA, 3350 bp, Homo sapiens
agagagactgaggcaggcgactgaatgcactaacagcagcaggctcagacctgcttccctggacatttccgggaccgtgagcgagggaaccacgttgccctggattcttgccagctgtacaaagttgaccaggaaaatggctcagcagacaagcccggacactttaacagtacctgaagtggataatccgcattgtccaaacccgtggctgaacgaagaccttgtgaaatccttgcgagaaaacctgttgcagcatgagaagtccaagacagcgaggaaatcggtttctcccaagctctctccagtgatctctccgagaaattcccccaggcttctgcgcagaatgcttctcagcagcaacatccccaaacagcggcgtttcacggtggcacatacatgttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaacagtgcaaaaactttcatgccttttttttttttaagtagaaaaattgtttccaaagtgcatgtcacatgccacaaccacggtcacacctcactgtcatctgccaggacgtttgttgaacaaaactgaccttgactactcagtccagcgctcaggaatatcgtaaccagttttttcacctccatgtcatccgagcaaggtggacatcttcacgaacagcgtttttaacaagatttcagcttggtagagctgacaaagcagataaaatctactccaaattattttcaagagagtgtgactcatcaggcagcccaaaagtttattggacttggggtttctattcctttttatttgtttgcaatattttcagaagaaaggcattgcacagagtgaacttaatggacgaagcaacaaatatgtcaagaacaggacatagcacgaatctgttaccagtaggaggaggatgagccacagaaattgcataattttctaatttcaagtcttcctgatacatgactgaatagtgtggttcagtgagctgcactgacctctacattttgtatgatatgtaaaacagattttttgtagagcttacttttattattaaatgtattgaggtattatatttaaaaaaaactatgttcagaacttcatctgccactggttatttttttctaaggagtaacttgcaagttttcagtacaaatctgtgctacactggataaaaatctaatttatgaattttacttgcaccttatagttcatagcaattaactgatttgtagtgattcattgtttgttttatataccaatgacttccatattttaaaagagaaaaacaactttatgttgcaggaaaccctttttgtaagtctttattatttactttgcattttgtttcactctttccagataagcagagttgctcttcaccagtgtttttcttcatgtgcaaagtgactatttgttctataatac

SEQ ID NO: 22297 - DNA, 494 bp, Homo sapiens
ggtcacacagagagtacgtgtcaaaggaaactcaaaagaacacattttctcagtgattacaggttttagagaagaggaacaatgcttcctctgagcctgaagaaaagaatgaaataagggctgcaagggaacatgcaggtttcacactacaggagcttgtctgtcttggtgcaagtgggagcattccagttggcttttgagtggatacgtgcagtgagatcattgacactggaaacactagttcccattttaattacttaaaacaccacgatgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccc

SEQ ID NO: 22298 - DNA, 2247 bp, Homo sapiens
atgaaaagaaatacctgtgatttgctttctcggagcaaaagtgcctctgaggaaacactacattccagtaatgaagaggaagaccctttccgcggaatggaaccctatcttgtccggagactttcatgtcgcaatattcagcttccccctctcgccttcagacagttggaacaagctgacttgaaaagtgaatcagagaacattcaacgaccaaccagcctccccctgaagattctgccgctgattgctatcacttctgcagaatccagtggttttgatgtggacaatggcacatctgcgggacggagtcccttggatcccatgaccagcccaggatccgggctaattctccaagcaaattttgtccacagtcaacgacgggagtccttcctgtatcgatccgacagcgattatgacctctctccaaagtctatgtcccggaactcctccattgccagtgatatacacggagatgacttgattgtgactccatttgctcaggtcttggccagtctgcgaactgtacgaaacaactttgctgcattaactaatttgcaagatcgagcacctagcaaaagatcacccatgtgcaaccaaccatccatcaacaaagccaccataacagaggaggcctaccagaaactggccagcgagaccctggaggagctggactggtgtctggaccagctagagaccctacagaccaggcactccgtcagtgagatggcctccaacaagtttaaaaggatgcttaatcgggagctcacccatctctctgaaatgagtcggtctggaaatcaagtgtcagagtttatatcaaacacattcttagataagcaacatgaagtggaaattccttctccaactcagaaggaaaaggagaaaaagaaaagaccaatgtctcagatcagtggagtcaagaaattgatgcacagctctagtctgactaattcaagtatcccaaggtttggagttaaaactgaacaagaagatgtccttgccaaggaactagaagatgtgaacaaatggggtcttcatgttttcagaatagcagagttgtctggtaaccggcccttgactgttatcatgcacaccatttttcaggaacgggatttattaaaaacatttaaaattccagtagatactttaattacatatcttatgactctcgaagaccattaccatgctgatgtggcctatcacaacaatatccatgctgcagatgttgtccagtctactcatgtgctattatctacacctgctttggaggctgtgtttacagatttggagattcttgcagcaatttttgccagtgcaatacatgatgtagatcatcctggtgtgtccaatcaatttctgatcaatacaaactctgaacttgccttgatgtacaatgattcctcagtcttagagaaccatcatttggctgtgggctttaaattgcttcaggaagaaaactgtgacattttccagaatttgaccaaaaaacaaagacaatctttaaggaaaatggtcattgacatcgtacttgcaacagatatgtcaaaacacatgaatctactggctgatttgaagactatggttgaaactaagaaagtgacaagctctggagttcttcttcttgataattattccgataggattcaggttcttcagaatatggtgcactgtgcagatctgagcaacccaacaaagcctctccagctgtaccgccagtggacggaccggataatggaggagttcttccgccaaggagaccgagagagggaacgtggcatggagataagccccatgtgtgacaagcacaatgcttccgtggaaaaatcacaggtgggcttcatagactatattgttcatcccctctgggagacatgggcagacctcgtccaccctgacgcccaggatattttggacactttggaggacaatcgtgaatggtaccagagcacaatccctcagagcccctctcctgcacctgatgacccagaggagggccggcagggtcaaactgagaaattccagtttgaactaactttagaggaagatggtgagtcagacacggaaaaggacagtggcagtcaagtggaagaagacactagctgcagtgactccaagactctttgtactcaagactcagagtctactgaaattccccttgatgaacaggttgaagaggaggcagtaggggaagaagaggaaagccagcctgaagcctgtgtcatagatgatcgttctcctgacacgtaa

SEQ ID NO: 22299 - DNA, 3020 bp, Homo sapiens
gtggagcagagagtgcttggcgggcgggtgccccgaagcctgaggaattgatgcatagtcggggtgcgtggactccaggacgcgcccctttgcagaaagagtccgtgccccgctgccgcctgctctgggcagcggccgtcgggcagcgggtgctggccgtcttggccgggagggtgacacacgcccggcagtgatggtcgaggagcccgcccgggttcgacgcccgggtcccactcgccggcgcgcggccgcggctctgccggtcgctccccgccagggggcggcgcagcgcggggcgagcgggaggcgacgggcggcggcgcggaggccggggccgtgagggagctggttctgagtcgccgacctcacctcacctcacctgcgcgcgttgttgcccctacggagcctcctggagtccaggatcggcggagttcgaaaacgaacttcccacgtttgctatgttgccctttggagacaaaacaagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctag

SEQ ID NO: 22300 - DNA, 7154 bp, Homo sapiens
gctgccgccgccgccgccgcctcctgggaaccaggggactgaagagcctgcgagagcggaacactgccggaccccgggtggggggggcgcagcagctgcgcctggccccgcccaccacacctgggcgcccgtagaaccgcgcggggcggggcggggcaggaggctggcctggcgctccggccgctttgtcgaaagccggcccgactggagcaggacgaagggggagggtctcgaggccgagtcctgttcttctgagggacggaccccagctggggtggaaaagcagtaccagagagcctccgaggcgcgcggtgccaaccatggagcgggccggccccagcttcgggcagcagcgacagcagcagcagccccagcagcagaagcagcagcagagggatcaggactcggtcgaagcatggctggacgatcactgggactttaccttctcatactttgttagaaaagccaccagagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatgaa

SEQ ID NO: 22301 - DNA, 6733 bp, Homo sapiens
gagggacgagtccacgggacagcccaaaggcaacatgacggaaccttgccaaaagaaatggtcaatgcatggtttgctgagagagttcacaccatccctgtgtgcaaggaaggtatcagaggccacaccgaatcttgctcttgtcccttgcagcagagtcctcgtgcagataacagtgcccctggaacaccaaccaggaaaatctctgcctctgaatttgaccggcctcttagacccattgttgtcaaggattctgagggaactgtgagcttcctctctgactcagaaaagaaggaacagatgcctctaacccctccaaggtttgatcatgatgaaggggaccagtgctcaagactcttggaattagtgaaggatatttctagtcatttggatgtcacagccttatgtcacaaaattttcttgcatatccatggactgatatctgctgaccgctattccctgttccttgtctgtgaagacagctccaatgacaagtttcttatcagccgcctctttgatgttgctgaaggttcaacactggaagaagtttcaaataactgtatccgcttagaatggaacaaaggcattgtgggacatgtggcagcgcttggtgagcccttgaacatcaaagatgcatatgaggatcctcggttcaatgcagaagttgaccaaattacaggctacaagacacaaagcattctttgtatgccaattaagaatcatagggaagaggttgttggtgtagcccaggccatcaacaagaaatcaggaaacggtgggacatttactgaaaaagatgaaaaggactttgctgcttatttggcattttgtggtattgttcttcataatgctcagctctatgagacttcactgctggagaacaagagaaatcaggtgctgcttgaccttgctagtttaatttttgaagaacaacaatcattagaagtaattttgaagaaaatagctgccactattatctctttcatgcaagtgcagaaatgcaccattttcatagtggatgaagattgctccgattctttttctagtgtgtttcacatggagtgtgaggaattagaaaaatcatctgatacattaacaagggaacatgatgcaaacaaaatcaattacatgtatgctcagtatgtcaaaaatactatggaaccacttaatatcccagatgtcagtaaggataaaagatttccctggacaactgaaaatacaggaaatgtaaaccagcagtgcattagaagtttgctttgtacacctataaaaaatggaaagaagaataaagttataggggtttgccaacttgttaataagatggaggagaatactggcaaggttaagcctttcaaccgaaatgacgaacagtttctggaagcttttgtcatcttttgtggcttggggatccagaacacgcagatgtatgaagcagtggagagagccatggccaagcaaatggtcacattggaggttctgtcgtatcatgcttcagcagcagaggaagaaacaagagagctacagtcgttagcggctgctgtggtgccatctgcccagacccttaaaattactgactttagcttcagtgactttgagctgtctgatctggaaacagcactgtgtacaattcggatgtttactgacctcaaccttgtgcagaacttccagatgaaacatgaggttctttgcagatggattttaagtgttaagaagaattatcggaagaatgttgcctatcataattggagacatgcctttaatacagctcagtgcatgtttgctgctctaaaagcaggcaaaattcagaacaagctgactgacctggagatacttgcattgctgattgctgcactaagccacgatttggatcaccgtggtgtgaataactcttacatacagcgaagtgaacatccacttgcccagctttactgccattcaatcatggaacaccatcattttgaccagtgcctgatgattcttaatagtccaggcaatcagattctcagtggcctctccattgaagaatataagaccacgttgaaaataatcaagcaagctattttagctacagacctagcactgtacattaagaggcgaggagaattttttgaacttataagaaaaaatcaattcaatttggaagatcctcatcaaaaggagttgtttttggcaatgctgatgacagcttgtgatctttctgcaattacaaaaccctggcctattcaacaacggatagcagaacttgtagcaactgaattttttgatcaaggagacagagagagaaaagaactcaacatagaacccactgatctaatgaacagggagaagaaaaacaaaatcccaagtatgcaagttgggttcatagatgccatctgcttgcaactgtatgaggccctgacccacgtgtcagaggactgtttccctttgctagatggctgcagaaagaacaggcagaaatggcaggcccttgcagaacagcaggagaagatgctgattaatggggaaagcggccaggccaagcggaactgagtggcctatttcatgcagagttgaagtttacagagatggtgtgttctgcaatatgcctagtttcttacacactgtctgtatagtgtctgtatttggtatatactttgccactgctgtatttttatttttgcacaacttttgagagtatagcatgaatgtttttagaggactattacatattttttgtatatttgttttatgctactgaactgaaaggatcaacaacatccactgttagcacattgataaaagcattgtttgtgatatttcgtgtactgcaaagtgtatgcagtattcttgcactgaggtttttttgcttggggattattttaaataattggtttttgtgttttctgaattaccattttttcaagaatgtttggaatctttcctttttcaaaagtaggttaggagcaaattatcatacattctgtgacatttaaagcctttataggatagtgaaaaatgctggctgagtggattttaagagaaataattgtatttgttaacagtgtctttttttaaaaagttaaggcactctgaaacaaatggaaagtcctatgaaactgtattgtaaagaaaacattatttaattgatatgctgttttgtgagagaacaggcaagacagaactttgtcacttcagtgcagtacatttttctgaaagctacccataaaatcactttcatctcacctacctgatgcaaagcaggtgaaaccttaggagatgatccagtcactgacttgattgagggataagtgtgatttagaaatggaatggccttggatgtctatcagtgaagaaaaatgttctgttagaagatctctctaagagtttttttccttctgagcttccttttcaaaataaaagtgacaattgtagcattgacttgaagtgagacatggttatagataagagagtacaaaatgactctttttcctgtcaattgaaatttaaagaaaagttttaattatataaatagcaaagggctattgccaatactagggtcaaaaatgaatttgagggaacagtgggtaagaaactttatgcctgaataacatttagcagtattgtgattgaaaaattgccatattttgatgtataggacaagtcaactgagatccagagaatcctggatgtgaatgctaaacactggcccttaactcacattcaatgtattttcttcccataacatttagtatagttaatattttcttagaatttgagcccatttaagtggattaatattctacatgtgtgcccctaaagacacatttactcaatattggagaagtagataatgaattaagcaactggtctaggaaaggaaaatttgtttcaaatatgcaggaatgtttggatttggggagagtagaaggagagatttgcttgatttgttaacttctacctccaacccacaaaaaagatatttgatctgagtttctatcactaatttggatagaaaatttctaagggacatggtaatccagcattctcaaggacctttcgccaaaatgtgttttccatctatgtcccgattcccctaaattttgcctaaaattcagtatgttccttaagtttttaaaattctgagtgtgtacaaatatcttgacataatgcagttttatttttatcattctggtaaaaaaacaaaaaatagaagcaaaacacattgtattgccattattttgtatttggtaaaggttaatctaggaagttaccaactgtttaatgctatatgtattgtatacttgtattttcaggatattttattttttttgccatacagataaaatttgtaaggttgcccctttgtggcactggtgtgtaaaatacacagactatcactaaaataatagttatatatacatacaggtgtatacttatgcatgcatacataaatccttagtatagaaaaattgcataaagaatagcaatctttaataaacctttttattacattgtgatttagcagttatgctaaaatatgtacttatgctttagtagtttgtttggtcccctctagtatgtgtcactgagaaattttttaaagacatggtagatcgtgtttagaggctttgtatgtgtgtcattttaataagcaagaagatatatttagattagaaatggtttggtctgcctttgaatattgtttattttactttactagttgagacattaaaggaagctgggcaatgcctattttatttctttgttggatattttagttcatacaaagcagagtacttctttagggctggttaattggttcaaataatttttaatttcctttctagtatcttctcaagttggaaaaatatacatacagtcctccttcaccttactctgtatttatattacccataactagcaagaagttcttgttctagattttttgtttgtttagttataacagagtaacataccatttaattacaatttttagccagaaaagtccccactattttactaacttgttaaaagatatctatataattgcctggccttatatttttcagtagattagaccgtgccaatcacaatcctgggtggatttgtgtaagtcacttaacctctgtgtgcctaaacaagttgtgcttttttaaaaggagttatgtttgggcaaagcctttgtcttcaagcagaatgtcacagaaggcagctactttataagccccaatgggccatggagaccactgtcagaaatgggatattagtctagagagaaggtgatctattcccacatgtcatttctaatgttgagtttccatgactgaacaaagagaatatatttattcagcttcacttgcagatcactagtgaatgtgagatttagagctcattgagtatattgcttcaaggtacaaacccaggatgatgatgttgtcaccactgtctcttaattttgaataatagtttcctttaataggagtattagagataagaaagtatatgaaaatatactggaaatattggattcttggagaaaactgttcagtcacagatatattcttgcctagcagtgaagtgcctttattttcagcatagcaaataaatattagacctgttccaatttgatctacaatttttttctgtgtttttcaccagattgtactcctaaaacttaacaggccatcacaagcaattgtcttttgtttacaagattgatttaatatgagaggatacaaaatgtcatcgttatcctctcttatgaacaactgtagtcaaaataaggtggcacaatttaattgttttgtatcagaaatacactgacccaccttttattgagtcctgccacatgttaggtaccgtgctctgctgtggagacagagcagtgaccccaaggagctcacggtccctgaaggaggtgctagagaagagacttagcttctgatactgccaatttaatgtgagaacatggggtatactgcatcatttccattttcatcaataacatatgttttatgcaccttctttacctgaaacttactaagaatctaccagtaaacaaacatcctgtctttttgcaagtatgaatcacttaacctgctgatagttgaagaacactttaggagttttgtattcttgtatatagtttattttttccatgtgctagccaggtaaagattacacagttcttctggactgttaaattgtgcatggttttggaccccttctgctctactacagagagtgaagaagaaagtattaaagctcactttaccattccatatacttactaaaagcctgtgtaaacatgtcttaatgaatgttgttgaaagcaatgtaaatagttgaaaatataaatttatattacagtttaagaaaaccttatgaggcatcactagccactgttaatatctatttgtattcttataccttttcaatatatttgaacaaatatagtttctggcactatttttatactaggaaaaggagttactatgtatattatgcttagcttttaaggcattttaaataaccatgaatgttgatttcattactttcctttcctccatcacgagagtcatttcagatgactctttcatgacaaaatcactttaaaggaacacttacctccgattcctgtataaagtcatgagatggtcaaggtggttttccattgtgcaaattcttcacctgtcagtggtttcctcattttgccatgctttgtaaaaataaaaagaatgatcaagtaggtatg

SEQ ID NO: 22302 - DNA, 5642 bp, Homo sapiens
agtatgttttgcagacaagacccagagaagtccagactggacttgttgcagactgcaaaactgccattggaaggcctccgtcccagtccttctacagagtagccagtgggattcccagccatgggcgaggtgacagcagaggaggtggagaagttcctggactcgaatattggctttgccaaacagtactacaacctccactaccgggccaagctcatctccgacctccttggggccaaggaggctgccgtggacttcagcaactaccactccccgagcagcatggaggagagcgaaatcatctttgatctcctgcgggactttcaggagaatttacagacagagaaatgcatcttcaatgtcatgaagaagctgtgcttcctcctgcaggcagaccgcatgagcctgttcatgtaccggacccgcaatggcatcgcagagctggccaccaggcttttcaatgtccacaaggatgctgtcctcgaggactgcctggtgatgcccgaccaagagatcgtcttccctttggacatgggcatcgtgggccatgtcgcacactctaagaagattgctaacgtccccaacacagaggaggatgagcatttctgtgactttgtggacatcctcacagagtacaagaccaagaacatcttggcttcccccataatgaatgggaaggatgtggtggccataatcatggctgtgaataaagtggatggatcccacttcaccaagagagatgaagagattcttctcaagtacctcaattttgcaaatctaatcatgaaggtgtaccacctgagttacctgcacaactgtgaaactcgacgtggccagatactgctgtggtctgggagcaaagtctttgaagaacttacggacatcgaacgacagttccacaaagccctgtacacagtccgtgctttcctcaactgtgacagatactctgtgggtctcttagacatgaccaagcagaaggaattttttgatgtgtggccggttctgatgggtgaagttccaccttactctggtcccaggactccggatggaagagaaattaacttttacaaggtcattgactacatcctgcatggcaaagaggacatcaaagtcatcccgaatccacctcctgaccattgggctttagtaagcggtctcccagcttatgttgcccagaatggcctgatttgcaacatcatgaatgcgcctgcggaggacttttttgcatttcagaaagaacctctggatgagtctggatggatgattaaaaatgtgctttcaatgccgattgtgaacaagaaggaagaaattgttggagtggccacattttacaatcgtaaagatgggaagccctttgatgaaatggatgagacgctcatggagtctttgactcaatttctgggctggtctgtcttaaatcctgacacctatgagtcaatgaataaacttgaaaataggaaggatattttccaggacatagtaaaatatcatgtgaagtgtgacaatgaagaaattcagaaaatcttgaaaaccagagaggtgtatgggaaggagccatgggagtgtgaggaagaggagctggctgagatcctgcaagcggagctgccagatgcagataaatacgaaattaataaatttcacttcagtgacttacccctaacagaactggagctggtaaaatgtggaatacagatgtattatgagctcaaagtggtggataaatttcacattccacaagaggccctggtgcggttcatgtactccctgagtaagggctaccgcaagatcacctaccacaactggcggcacggcttcaacgtggggcagaccatgttctccctgctggtgacgggaaagctgaagcgctacttcacggacctagaggccttggccatggtcactgctgctttctgccatgacattgaccacagaggcaccaataacctctaccagatgaaatcccagaacccactggccaagctccatgggtcctctatcttggaaagacaccacttggagtttggcaaaacactgctcagagacgagagcctgaatatctttcaaaacctcaatcgtcgacagcatgagcatgccatccacatgatggacattgcaatcattgccacagacctcgccctgtatttcaagaagaggacgatgttccaaaagatcgtggatcagtctaagacatatgagagtgaacaggagtggacacagtacatgatgctggagcagacacggaaggaaatcgttatggccatgatgatgaccgcctgtgatctctcagccatcaccaaaccctgggaggtgcagagccaggtagctctgctggtggctgctgaattctgggaacaaggtgacctggagcgcacggtgctgcaacagaatcccattcccatgatggacagaaacaaagcagatgaactccctaagcttcaagtcggcttcattgactttgtttgcaccttcgtctacaaggaattctcccgtttccacgaggagatcaccccaatgttggacgggatcaccaacaatcgcaaggagtggaaggcgcttgctgatgagtacgatgccaagatgaaggtgcaggaggagaagaagcagaaacagcagtcggccaagtcagcagccgcaggaaatcagccggggggaaaccccagcccagggggtgcaactacatccaagtcctgctgcatccagtaacaccactggggatgtgctggctggacggcaccaccctttcctgggaagagatgactcaagccagtggaagaccacacaccttgagaagtagaagagtcataggatttgaaagctgttagagaatttagcttccaggactgttcaatcttttggcttccctgggccacattggaagaattgtcttgggtcacacataaaatacagtaacactaatgatagctgttgaacttaaaaaaaaaaatcgccaaaaaaaaaaatttcataatgttttaagaaagtttatgaatttgtgttgggccgcattcaaagccgtcctgggctgcatgtggcccacgggccgtgggttgaacaagcttggcttataccttatccagtggcttttaaacattcttttagtcttgagaactgcctattgagctaaaaccaatattctagctttcatagacatcagttaaacatttaattacatttaattaatgccagattcactggcttgcttagaatcatttttgttcttatactttcagttaatgtattgtaaaaattttcaatcattttcaaaagtagagaattgtacgttgaatccccacatacccatcacccagattccaatatcaagattttgctacatgcatttcgtctgtcctttttacattttcttttcaattttttttcttacctgaagtgtttaaaggcaaatcctggccaggcgtggtggctcacacctgtaatcccagcacttcaggaggctgaggtgggcagactgcatgagcccaggagtctgagaccaacctgagcaaaatggcaaaaccctgtctctacaaaaaatacaaaaattagcactcacctgtagtctcagctacctgggaggcagaggtgagaggatctcttgaacccaggaggcggaagttgcagtgagctgagatcatgctactgcactccagcttgggcgaccgagcgagactctgactcaaacaaaagcaaaagaaaaggcaaatcccaaacatatcatttcacacctctactatctcatctttaaagaaataagtatgttttctaacataaccacatcactggcccatgcaaccaatgcctgcctaatacccagctgtgatctatgctttgatgggctgcacagaccccaagcttcagcaaaggacttgggaccccaccagctttgagtgctgttgacagacccttagtatcaaccccatcaggtgttactgcagccttccccagggtggcctacacccaatgactgatccatgccaggtggagaggcctggccatcttggctgagcatgggataactgtgcagggctgttccagctccacgactcctcgtggggtccactaaggctgtcgctgggctcacatcccaactcgacttctccctctgcccactcctatttccttcccttccccaagcatcggtccccagggcactgcttaataagcatcctgcagactaagtccattttagagtctgctttctgggacacccaacttgtgatgccagcccttaatcaaccttccttcattctcatgaacgttttcaatggttggcttgcctgaatctgatccaaacaaattcacatattgaatttagttgtttctttttgttggtttttagaaaaaagaagatgtactttttattcttggatttttcattgatttcacagagtataaattaagtcagattattctcaattccagaacttctgtttcttaaattagcaggcattctgttggtttaaaaagatagatgttggccgggcgcggtggctcacgcctgtaattccagcactttgggaggccaaggtgggtggatcacctgaggtcaggagttcaagaccagcctggccaacatggtgaaaccccatctctactaaaaatacaaaaattagctgggtgtggtggtgtgcacctgtaatcccagctactcaggaggctgaggcaggagaatcgcttgaacctgggaggcgaaggttgcagtgagctgagatcatgccactgcactccagcctgggcaacaagagcaagactccgtctcaaaaaaaaaaaaaagaaaaaaaaaagatgtggcagatagaatttctctctttctctatctttcatgacgaggtctcactctgtcgcccaggctggagtgcagtggtatgaccatagctcactggagccccagctgcccgggctcaagcaatcctccatctcagcttaccaagcagcggtgaccacaggcatgcaccaccatgcccagctaattttttaaaacctatctttgtagacatggggtctcattctgttgcccaggctggcctcaaactcctgacttcaagcaatcctcctgcctcagcctcccaaagtgttgggattacaggcgtgagccactgcacctggccaggacttatttcttttaaaccgaatctaagtatgttctggcaagtatgcaatacctagcggaatgcactggcctgatcagcattcataccatagtaactgatgttgaaaacagcacaaataaaccagaagttgaaaatggcaataacatgctaaaaatttgcaagtcaatttgttacacttgtccaaatcttgattttttttccttctctatcgttccccccccaccaccagctttatggaggtataattagcaaataaaaagtatacatatttaaggtatacactgtgatgttttgatatacattgtgaaatggttaccataattaagctaattaatatatccatcacctcacatagccatggttaagtttctgaagtctcttttaatctacaaagtactccttccttttttccattgtcatcaccttgcagaaacagagtcagttttcccacattctgtatttatctgtttgtttctttgtggccgcatgtaacacattcctctgtctcattctaataaatggacattagctcta

SEQ ID NO: 22303 - DNA, 2120 bp, Homo sapiens
gcagcggaggagagggagctggcaccatgcggtagaagacccagcggccgccgcgagtgtgaggaggcagggcctggtggggcctgggtctgggccttgaccaaggaggcagagaaaggtggcccaaggagggccctggggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacgtcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccatggggaccctatggctccctcaatcttcacccactaggatttgggttctgcctgtggctatttgctacaagaggttaggaagcccaagaaaatgactgaagatcattctggata

SEQ ID NO: 22304 - DNA, 3280 bp, Homo sapiens
tgcgtgcctggagcagcagcgtctccagggacaggcagccaccatgagcctcagtgaggagcaggcccggagctttctggaccagaaccccgattttgcccgccagtactttgggaagaaactgagccctgagaatgtggccgcggcctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacgtcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaaggcacagaaatttgcaatggcggcccagcacccaagtcttcaacctgctgtatcctgtgagcactggtcccatggggaccctatggctccctcaatcttcacccactaggatttgggttctgcctgtggctatttgctacaagaggttaggaagcccaagaaaatgactgaagatcattctggatattttaatttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcaggaattcagaataaaataaacagaaaacta

SEQ ID NO: 22305 - DNA, 3232 bp, Homo sapiens
ctccagggacaggcagccaccatgagcctcagtgaggagcaggcccggagctttctggaccagaaccccgattttgcccgccagtactttgggaagaaactgagccctgagaatgtggccgcggcctgcgaggacgggtgcccgccggactgcgacagcctccgggacctctgccaggtggaggagagcacggcgctgctggagctggtgcaggatatgcaggagagcatcaacatggagcgcgtggtcttcaaggtcctgcggcgcctctgcaccctcctgcaggccgaccgctgcagcctcttcatgtaccgccagcgcaacggcgtggccgagctggccaccaggcttttcagcgtgcagccggacagcgtcctggaggactgcctggtgccccccgactccgagatcgtcttcccactggacatcggggtcgtgggccacgtggctcagaccaaaaagatggtgaacgtcgaggacgtggccgagtgccctcacttcagctcatttgctgacgagctcactgactacaagacaaagaatatgctggccacacccatcatgaatggcaaagacgtcgtggcggtgatcatggcagtgaacaagctcaacggcccattcttcaccagcgaagacgaagatgtgttcttgaagtacctgaattttgccacgttgtacctgaagatctatcacctgagctacctccacaactgcgagacgcgccgcggccaggtgctgctgtggtcggccaacaaggtgtttgaggagctgacggacatcgagaggcagttccacaaggccttctacacggtgcgggcctacctcaactgcgagcggtactccgtgggcctcctggacatgaccaaggagaaggaattttttgacgtgtggtctgtgctgatgggagagtcccagccgtactcgggcccacgcacgcctgatggccgggaaattgtcttctacaaagtgatcgactacgtcctccacggcaaggaggagatcaaggtcattcccacaccctcagccgatcactgggccctggccagcggccttccaagctacgtggcagaaagcggctttatttgtaacatcatgaatgcttccgctgacgaaatgttcaaatttcaggaaggggccctggacgactccgggtggctcatcaagaatgtgctgtccatgcccatcgtcaacaagaaggaggagattgtgggagtcgccacattttacaacaggaaagacgggaagccctttgacgaacaggacgaggttctcatggagtccctgacacagttcctgggctggtcagtgatgaacaccgacacctacgacaagatgaacaagctggagaaccgcaaggacatcgcacaggacatggtcctttaccacgtgaagtgcgacagggacgagatccagctcatcctgccaaccagagcgcgcctggggaaggagcctgctgactgcgatgaggacgagctgggcgaaatcctgaaggaggagctgccagggcccaccacatttgacatctacgaattccacttctctgacctggagtgcaccgaactggacctggtcaaatgtggcatccagatgtactacgagctgggcgtggtccgaaagttccagatcccccaggaggtcctggtgcggttcctgttctccatcagcaaagggtaccggagaatcacctaccacaactggcgccacggcttcaacgtggcccagacgatgttcacgctgctcatgaccggcaaactgaagagctactacacggacctggaggccttcgccatggtgacagccggcctgtgccatgacatcgaccaccgcggcaccaacaacctgtaccagatgaagtcccagaaccccttggctaagctccacggctcctcgattttggagcggcaccacctggagtttgggaagttcctgctctcggaggagaccctgaacatctaccagaacctgaaccggcggcagcacgagcacgtgatccacctgatggacatcgccatcatcgccacggacctggccctgtacttcaagaagagagcgatgtttcagaagatcgtggatgagtccaagaactaccaggacaagaagagctgggtggagtacctgtccctggagacgacccggaaggagatcgtcatggccatgatgatgacagcctgcgacctgtctgccatcaccaagccctgggaagtccagagcaaggtcgcacttctcgtggctgctgagttctgggagcaaggtgacttggaaaggacagtcttggatcagcagcccattcctatgatggaccggaacaaggcggccgagctccccaagctgcaagtgggcttcatcgacttcgtgtgcacattcgtgtacaaggagttctctcgtttccacgaagagatcctgcccatgttcgaccgactgcagaacaataggaaagagtggaaggcgctggctgatgagtatgaggccaaagtgaaggctctggaggagaaggaggaggaggagagggtggcagccaagaaagtaggcacagaaatttgcaatggcggcccagcacccaagtcttcaacctgctgtatcctgtgagcactggtcccatggggaccctatggctccctcaatcttcacccactaggatttgggttctgcctgtggctatttgctacaagaggttaggaagcccaagaaaatgactgaagatcattctggatattttaatttttttttttttttttttttgagatggagtcttgctctgtcacccaggctggagtgccgtggcacgatctcagctcactgcaacctccacctcccaggttcaagcgattctcgtgcctcagcctcctgagtagctgggactacaggcgcccaccaccacacatggctaatttttgtattttcagtacagatggggtttcaccatattgggcaggctggtctcgaactcctgacctcaggtgatcacccgcctcagcttcctgaagtgctgggattacaggcatgagccaccacgcccagcctgtttttataaactgaagccaactgtgaataaactgtagcctacattactcatccatttttggatagttaccactgggagacctttgaaaagggtccatgaactctgaaatcactgagaacatttgcagccacacatgtacatatgtgtacacaggtagacagatggacacaggccgtttctcatccagtttaggaaaacacacatgctcag

SEQ ID NO: 22306 - DNA, 3307 bp, Homo sapiens
ctttggaagtcctatgagggaccatttacggtttcctcagtaatttccaccaggatgaatttccttctcatcactctgcctcaggtagtgctctgaaggtcgtcctttctgaacaaacgcagcaaagcaagccacaccatgggtgagatcaaccaagttgccgtggagaaatacctggaggagaaccctcagtttgccaaggagtactttgacaggaagttgcgggtggaggtgctgggagaaatcttcaagaacagccaggtgccagtccagtccagcatgtccttctctgagctgacccaggtggaggagtcagccctgtgcttggagctgctgtggaccgtgcaggaggaggggggcaccccagagcagggggttcacagggccctgcagaggctggcccacctgctccaggctgaccgctgcagcatgttcctgtgccggtcccggaacggcatacctgaggtggcctctaggttgctggatgtcacccccacctccaagtttgaggacaacctggtgggccctgacaaagaagttgtgtttccattggacattgggatagtgggttgggctgctcacacgaagaaaactcataatgtcccagatgtgaaaaagaacagccatttttctgacttcatggacaagcaaactgggtatgtcactaagaacctgctggcaaccccgatcgtggtgggcaaggaggttcttgctgtgatcatggcagttaacaaagtaaatgcatctgaattttccaaacaggatgaagaggtcttttccaaatacctcaactttgtgtctatcatcctaaggcttcatcacaccagctacatgtacaatattgaatcccgaagaagccagatccttatgtggtcagccaataaagtatttgaagaactcacagatgttgagcgacagtttcacaaagcgctctacacggttagatcatatctgaactgtgaacgatactccattggactgctggacatgaccaaggagaaggaattctacgatgaatggccaatcaagcttggagaagtagagccttataaaggtccaaagacacctgatggcagggaagtcaacttttataaaatcattgattacattttacatggaaaagaagagatcaaagtgattccgacgcctcctgcagaccactggacactcattagtgggttgccaacatatgttgctgaaaatggatttatctgtaacatgatgaatgcccctgcggatgaatacttcacatttcagaaaggacctgtagacgaaactggttgggtcattaagaatgttttgtccctgcctattgtcaacaagaaagaagatattgtgggagtggctacattttacaacaggaaggatggaaaacctttcgatgagcatgatgaatacattaccgagactctcacacaatttcttggatggtctcttttaaatactgacacctacgataagatgaataagctagaaaacagaaaggacattgctcaggaaatgctcatgaaccaaaccaaagccactcctgaagaaattaagtccattttgaaatttcaagagaagttaaatgttgatgtaattgacgactgtgaagaaaaacaacttgttgcaattttgaaagaggacttgccagacccacgctcagcagaactgtacgaattccgcttcagtgacttcccccttacagagcacggattgattaaatgtggaatacgactgttttttgaaataaatgtggtggagaaattcaaagtacctgtagaggttcttaccagatggatgtacactgtgaggaaagggtaccgagctgtcacttaccacaattggcggcatgggttcaacgtggggcagaccatgtttactttgctgatgacaggaagattaaagaagtactacacagatctcgaagcctttgccatgcttgctgctgctttctgccatgatattgaccacagaggcaccaataatttgtaccagatgaaatccacgtctccattagcaagacttcatggttcttctattttggagaggcaccacctggagtacagtaagactctgttgcaggatgagagtttaaacatcttccagaacctaaataagcggcagtttgaaacagttattcatttgttcgaggtcgcaataatagcaactgacctggctttatatttcaagaagaggaccatgtttcaaaaaattgttgatgcctgtgaacaaatgcaaacggaagaagaagccatcaaatatgtaactgttgatccaaccaagaaagagattatcatggcaatgatgatgacggcatgtgacttgtctgctattaccaagccctgggaggtgcaaagtcaggtagcacttatggttgcaaatgaattttgggaacaaggagatctggagagaacagtgttgcagcaacaacccattcctatgatggacagaaacaaaagagatgaattacctaaacttcaagttggatttattgattttgtttgtacttttgtatataaggagttctcacggtttcacaaagaaatcacacctatgctgagtggtcttcagaataacagagtagaatggaaatcactagctgatgagtatgatgcaaagatgaaggtcattgaagaggaggcaaaaaagcaagaaggaggagccgaaaaagctgctgaagattcaggaggtggtgatgacaaaaagtccaaaacatgtttaatgttgtaatattatctaactggtctaaacttcaaatatcattttacctttgaagaaaaccagaaaacattcaaaagaacttcaacaaatcatcacgtaacaggatcttcagaaaaactaccctgtgactatgaagaaaatatatattgctagcccaaaaatcccaggggcaaaataaagttcaacaaaagtgcaaaatatgacaaaaataggtacatttttggtgccaatttattttaaattaaaaaatatgcaatcctgaaactagtcacaaattcttttttaaaacattaattgtatttatttgctaaggctgctataacaaagtaccacagactgggtgcttaaccaatagaaatgtattttctcaaagtcctgggggctggaagttcaagatcaaggagttggcagggttggtttcttgggaggcctctcaacttggtttgcagatggccatcttctccctgtgtcttcacatggtcttccctctgtgtgtctgtgtcctaatctccttttcttataaggactccagtaggactggattagggcctacccatgtgacctcattttagtcttaattacctcgttaatggccttatct

SEQ ID NO: 22307 - DNA, 1175 bp, Homo sapiens
ctgcgaggctagggggaaggagaagggatcagaagcgggagctgaggggagagagaggccggtcctggtctggccgctgcggctgctagcccgaggtctccaagccgggctgcggctccatcctcggctcctgggcaccgtctgcgaggctccgccgaccagagtgagaaagccgcgggcggcgaccgccgcatcatgtcagccaaggacgagcgggccagggagatcctgaggggcttcaaactaaattggatgaaccttcgggatgctgagacagggaagatactctggcaaggaacagaagacctgtctgtccctggtgtggagcatgaagcccgtgttcccaagaaaatcctcaagtgcaaggcagtgtctcgagaacttaatttttcttcgacagaacaaatggaaaaattccgcctggaacaaaaagtttacttcaaagggcaatgcctagaagaatggttcttcgagtttggctttgtgatccctaactccacaaatacctggcagtccttgatagaggcagcacccgagtcccagatgatgccagcaagcgtcttaactgggaacgttatcatagaaacaaagttttttgacgacgatcttcttgtaagcacatccagagtgagacttttctatgtttgaaagaagaatgtgtgtacatttcaagaatttgggttttttggagggaggaggaaactgtttacttttttcctccacacgtttgatttttgacacatacacccctaattccctcaacagcagaacctacctgcagccaccaggggaccagctctgtgtaggtaaccagatggctctttttcccaagccaccatcttccagctgaccagactaaactcccaaccccagaccagggcaggggacaggtctcaagtccttcccagcatacacacagggaacaaacacataccacaaaccggtaactgtacctgtcaccctccttgtctcctccttgggccctacaggctacacatctacctttggcccctggttttggaaaaattccgtgttcctgacccatgtttagttttttcctaccatttctatttcatacattctcatacatttaacttgtaaaatagactgtgatattattacataatgtaattaaaaatatgaattaaaatattcctacagtctttagcatggca

SEQ ID NO: 22308 - DNA, 1505 bp, Homo sapiens
ggcttgcccttgaaggaactcaacattgtccttgcttctgtgcttgggaagacccacaggcccctaagggcgggggggggtccttgtttggtttcaggagcagcaggtgcaaaggccctggggtgggaggggtgagatgtgaggccacagcagcgggtgagggccaggctgcagagggttttggggaccatgaaggtgggcccttcagagatcaggcagggtcaggaaaggcagtagggaggcccaagacagcagacactgtggttgcttccatctggaagatgggcagctgcaggagcctggctgttcagggtcacacttctctccctgtcccggccccatctgctgggtgtccttccttggagcccttgacagcacctgagcccctcctctccatcccctgaaccttggtggttgtgccccccctcggggcccaacaatctcattagggtggcactgagacgcctaatcagctcatgaagcagcgagataaaggccggggctggcaccctgcggagggaggcccagcactcacagcacagccccctgagacccgccctgcacttgaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcctgcccttgcagtccctatttcaaaataaaattagtgtgtccttgcc

SEQ ID NO: 22309 - DNA, 1023 bp, Homo sapiens
cagcgagataaaggccggggctggcaccctgcggagggaggcccagcactcacagcacagccccctgagacccgccctgcacttgaccgcagcaggagggagtccaggagccaaggttgccgcggtgtctccgtcagcctcaccatgaacctggaaccgcccaaggctgagttccggtcagccaccagggtggccgggggacctgtcacccccaggaaagggccccctaaatttaagcagcgacagaccaggcagttcaagagcaagcccccaaagaaaggcgttcaagggtttggggacgacatccctggaatggaaggcctgggaacagacatcacagtcatctgcccttgggaggccttcaaccacctggagctgcacgagctggcccaatatggcatcatctagcacgaggccctgctgaagtccagaccctccccctcctgcccactgtgctctaaaccctgctcaggattcctgttgaggagatgcctccctagcccagatggcacctggacaccaggatgggactgcaacctcaggtctccccctacatattaataccagtcaccaggagcccaccacctccctctaggatgccccctcaggggctggccaggccctgctcaacatctggagatacaggcccacccctcagtcctgcccacagagaggcttggtcggtctccactcccagggagaacgggaagtggaccccagcccgggagcctgctggaccccagatcgtcccctcctcccagctggaaagctagggcaggtctccccagagtgcttctgcaccccagccccctgtcctgcctgtaaggggatacagagaagctccccgtctctgcatcccttcccaggggggtgcccttagtttggacatgctgggtagcaggactccagggcgtgcacggtgagcagatgaggccccaagctcatcacaccagggggccatccttctcaatacagcctgcccttgcagtccctatttcaaaataaaattagtgtgtccttgcc

SEQ ID NO: 22310 - DNA, 747 bp, Homo sapiens
caaagatccttttgtcttttgcaaagaaggcagctgggcagctgataggaacaacattcagctccgaggctgaaagggaaacatcagccgcccggggggagttaaaatgagtgacaacactactctgcctgctccagcttcaaaccagggtcctaccaccccacgcaaaggccctcccaagttcaagcagaggcagactcgccaattcaagagtaaacctccaaagaaaggtgtgaaaggatttggagatgacattccaggaatggaggggctaggaacagatatcacagtgatttgtccatgggaggcattcagccacctggaattgcatgagctcgctcagtttgggattatctgaagtgccagaggttctgccactctcaatgacatctgctgtaattttggttgcttttgccctgttgatctgccggagtcttgaaattcagctgattggaagtggtttctttgactttcaaggtcattccctatcagttactactaagagttctcttactgtcagaatctctcttgcagtacagctcaaaatagtggatgcatttcaaacttgaccaccttttcctaccagctagttagaagtcatcaatatttctctacattttgtttatctgtaagtcctttaaatctatttttgctaggcattcattatgattaatagtagacttttaagacaacatttatgtcactccccacctcctcatatttaataaaggagatatttaccttgaa

SEQ ID NO: 22311 - DNA, 2425 bp, Homo sapiens
ggaaggcagctgcttgaggtccaaggcagtcagtgtcccctctcttttgcctcgggacagctggtatttatcagactcctaagaagttttccttgctccctagtagaagagagagattatgcagcgggcttttgattgatccaatgggaattacattgatctggtgtctggccttggttcttatcaagtggatcacctctaagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatggg

SEQ ID NO: 22312 - DNA, 2977 bp, Homo sapiens
cgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggtaactatacatatttagatatagctggttagaaaaatgccactgtttttatcaagaagggaaatatatttgaaatataaaatattaaaattatgctcatttctatttttaaaaataatttaagaaattttacccttgttttcccttgttatggctcttctaattctcatttaattttaggatgtaaaaagtatatttttgcagaacaggcagcagcaataacttgtttctgttcttatgtaaataagaatccattattcgctcatgtggaagcttcttttgcatcatttgggactgccatttaaaaaaggataggtaaacaaagaaatgacaaaaataaaataaataaaataaaaatggataggtggtgacccactgagcctgatcataatacgaagaccagcttctgccactgcctttccagactcttaccactgcctgttgattaaatctaactcttcaacatcctagacaggcccttataatcttgcttcaaatgctgtgcagccatcttgcctcaacttccctctcatttgcctacagcatctcgggacgcttctgtgtttcccaagtatacgctgttctttcgctctttgtgcctcgccagtgctttccatgtgcctcgtagagttatttttcttgaagaggcagctcaaatgtcaccttctccagaagctgctctccacttgctttaggcagagtcagtcacttttcttctagattccaaagtgcctgatccacttggttgtggattcctggagcctagcaccacaccagaagcacgaggcccttgagaactgtgtgttgagtgaactaataactgtattatagaaagcataatgaaaatgtcctgtgactgaagtatgtgtagcttgttgcaggagttcacaggaaagttgactaggattgagtgtgttgggctttgggtataaaggagggggattctacgggggcagtagctcaacaaggaatagagggaggagtgtaattttggtagctggtgttgaatagggcctttgagaatcagactgaacacagtgaaatatgtgcccaaagttcagaaagatgaagtttccagaaactaagaaggtagcacaatatgtggcatcatactcagaaaggaagaccatgccatggggccagaaattcagaaacgtaattcttacattgtgattgcaatggatactcatggaagaaagtgggtagtggccgatttgacttcagagtgacaggtagagaagggaagagcgtgtagaactgtggccagactttaggagtgtgagggatgctgaatctcccagagagctcacactggccaggaatgctgagagtagcagatgcttttcttttgggaggatagtaaaacaatttagaaccagatatgctttgtcttgattctcaagtagaataatcttcaaatgcaaaagaatacattagaaatggacaaaagtggccaggagcggtagctcatacttgtaacccagcactttgggaagccgaggcgggctgatcgcttgaggtcaggagttcgagaccagcctggccaaaatagtgaaactcacgtttctactaaaaatacaaaaattagctgggtgtgatggccacttgggaggctgagataggagaatcgcttgaacctgggaggcagaggttgcagtgagccaatatcgtgccactgcattccagcctgggtgacagaatgaaactccatcactccatctc

SEQ ID NO: 22313 - DNA, 3673 bp, Homo sapiens
gctgctcctgagtcccgcgcgccctgggtctggccgctggctccagctgtcttttcttgcactgctttgctccgttcgtgctgcgctcgaactctgcagtccgggtacctgctcctctcggccgaggagccccagggcggcggggttccctttccgactttgcctgtgctggccccgcttgcaccccgtcccccctcgcctggagcgaggcgcgcgccggtcctggtaattggcgccgcggccgccgcggagccttcccgccggcggcccgagcggagggctggggttggggaggcgtgagcgcggcttcccagcccggggtcggtccccgcccgccctgcccccgtctcggcccggagcccccgagccgcggccccctcccactgcaggggccggcggccgcggcagggcgggcgccgcgcggaggcagggcgggcgtattcaatggaagtgtgttaccagctgccggtactgcccctggacaggccggtcccccagcacgtcctcagccgccgaggagccatcagcttcagctccagctccgctctcttcggctgccccaatccccggcagctctctcagaggcgtggagctatttcctatgacagttctgatcagactgcattatacattcgtatgctaggagatgtacgtgtaaggagccgagcaggatttgaatcagaaagaagaggttctcacccatatattgattttcgtattttccactctcaatctgaaattgaagtgtctgtctctgcaaggaatatcagaaggctactaagtttccagcgatatcttagatcttcacgcttttttcgtggtactgcggtttcaaattccctaaacattttagatgatgattataatggacaagccaagtgtatgctggaaaaagttggaaattggaattttgatatctttctatttgatagactaacaaatggaaatagtctagtaagcttaacctttcatttatttagtcttcatggattaattgagtacttccatttagatatgatgaaacttcgtagatttttagttatgattcaagaagattaccacagtcaaaatccttaccataacgcagtccacgctgcggatgttactcaggccatgcactgttacttaaaggaacctaagcttgccaattctgtaactccttgggatatcttgctgagcttaattgcagctgccactcatgatctggatcatccaggtgttaatcaacctttccttattaaaactaaccattacttggcaactttatacaagaatacctcagtactggaaaatcaccactggagatctgcagtgggcttattgagagaatcaggcttattctcacatctgccattagaaagcaggcaacaaatggagacacagataggtgctctgatactagccacagacatcagtcgccagaatgagtatctgtctttgtttaggtcccatttggatagaggtgatttatgcctagaagacaccagacacagacatttggttttacagatggctttgaaatgtgctgatatttgtaacccatgtcggacgtgggaattaagcaagcagtggagtgaaaaagtaacggaggaattcttccatcaaggagatatagaaaaaaaatatcatttgggtgtgagtccactttgcgatcgtcacactgaatctattgccaacatccagattggttttatgacttacctagtggagcctttatttacagaatgggccaggttttccaatacaaggctatcccagacaatgcttggacacgtggggctgaataaagccagctggaagggactgcagagagaacagtcgagcagtgaggacactgatgctgcatttgagttgaactcacagttattacctcaggaaaatcggttatcataacccccagaaccagtgggacaaactgcctcctggaggtttttagaaatgtgaaatggggtcttgaggtgagagaacttaactcttgactgccaaggtttccaagtgagtgatgccagccagcattatttatttccaagatttcctctgttggatcatttgaacccacttgttaattgcaagacccgaacatacagcaatatgaatttggctttcatgtgaaaccttgaatatgcaaagcccagcaggagagaatccgaaaggagtaacaaaggaagttttgatatgtgccacgactttttcaaagcatctaatcttcaaaacgtgaaacttgaattgttcagcaacaatctcttggaatttaaccagtctgatgcaacaatgtgtatcttgtaccttccactaagttctctctgagaaaatggaaatgtgaagtgcccagcctctgctgcctctggcaagacaatgtttacaaatcaactctgaaaatattggttctaaattgccttggagcatgattgtgaaggaaccactcaaacaaatttaaagatcaaactttagactgcagctctttccccctggtttgcctttttcttctttggatgccaccaaagcctcccatttgctatagttttatttcatgcactggaaactgagcatttatcgtagagtaccgccaagctttcactccagtgccgtttggcaatgcaattttttttagcaattagtttttaatttggggtgggaggggaagaacaccaatgtcctagctgtattatgattctgcagtgaagacattgcatgttgttttcactactgtacacttgacctgcacatgcgagaaaaaggtggaatgtttaaaacaccataatcagctcagggtatttgccaatctgaaataaaagtgggatgggagagtgtgtccttcagatcaagggtactaaagtccctttcgctgcagtgagtgagaggtatgttgtgtgtgaatgtacggatgtgtgtttgcgtgcatgtttgtgcatgtgtgactgtgcatgttatgtttctccatgtgggcaaagatttgaaatgtaagcttttatttattattttagaatgtgacataatgagcagccacactcgggggaggggaaggttggtaggtaagctgtaacagattgctccagttgccttaaactatgcacatagctaagtgaccaaacttcttgttttgatttgaaaaaagtgcattgttttcttgtccctccctttgatgaaacgttaccctttgacgggccttttgatgtgaacagatgttttctaggacaaactataaggactaattttaaacttcaaacattccacttttgtaatttgttttaaattgttttatgtatagtaagcacaactgtaatctagttttaagagaaaccggtgctttcttttagttcatttgtatttcccttgttactgtaaaagactgtttattaattgtttacagtttgttgcaacagccattttcttgggagaaagcttgagtgtaaagccatttgtaaaaggctttgccatactcattttaatatgtgcctgttgctgttaacttttgatgaataaaaacctatcttttcatatttttatctttgacatttaccttataactcaatcttttggaaaacacaatgctaaattacaaggaaatcaaagttagcttcttggctcttgtaattcatccctcagatgtttactcagtccgagcttatctactaatgactcaccttgcaagtgagtaagcagaagcccagtt

SEQ ID NO: 22314 - DNA, 3984 bp, Homo sapiens
agtagccgggccaaggcgggagcggctgcctctcagggtcgctccagggccgcgctaggaaagccgccgccgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaatca

SEQ ID NO: 22315 - DNA, 2663 bp, Homo sapiens
cgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagc

SEQ ID NO: 22316 - DNA, 3912 bp, Homo sapiens
ccgccgccgccgcagcgcccgcaccgcgataaaaggggcggccgcgtttcctgacgcgagatccgcgctcgccgccgcccgcccaggcggcgatgacacggcgcccgcggcggcccggaggcgccgggtgggccgtttgctgaccggatcgcggctacccgccagcgtgtccgcggcgccgccgccagcatgggctgtgccccgagcatccacatttccgagcgcctggtggccgaggacgcgcctagccccgcggcaccgccgctgtcgtccggcgggccgcgcctcccgcagggccagaagacggccgccttgccccggacccgcggcgccggcctcttggagtcggagcttcgcgacggcagcggcaagaaggtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttcttttt

SEQ ID NO: 22317 - DNA, 3716 bp, Homo sapiens
tcggagaggacaggaaggagccggctgcaccgcgccagggtctccgcaaaccgggagcccagggagggcgggaagactggcgggggtccgaggcagcccgctacaggatacgtgatggacgcccagagacaccgccctccagctggtgggggaggagccccagccaccaagaagtagcagtagctgatgtgcagtttggccccatgagatttcatcaagatcaacttcaggtacttttagtgtttaccaaagaagataaccaatgtaatggattctgcagggcatgtgaaaaagcagggtttaagtgtacagttaccaaggaggctcaggctgtccttgcctgtttcctggacaaacatcatgacattatcatcatagaccacagaaatcctcgacagctggatgcagaggcactgtgcaggtctatcagatcatcaaaactctcagaaaacacagttattgttggtgtagtacgcagggtggatagagaagagttgtccgtaatgcctttcatttctgctggatttacaaggaggtatgtagaaaaccccaacatcatggcctgctacaatgaactgctccagctggagtttggagaggtgcgatcacaactgaaactcagggcttgtaactcagtattcactgcattagaaaacagtgaagatgcaattgaaattacaagcgaagaccgttttatacagtatgcaaatcctgcatttgaaacaacaatgggctatcagtcaggtgaattaatagggaaggagttaggagaagtgcctataaatgaaaaaaaggctgacttgctcgatactataaattcatgcatcaggataggcaaggagtggcaaggaatttactatgccaaaaagaaaaacggagataatatacaacaaaatgtgaagataatacctgtcattggacagggaggaaaaattagacactatgtgtccattatcagagtgtgcaatggcaacaataaggctgagaaaatatccgaatgtgttcagtctgacactcatacagataatcagacaggcaaacataaagacaggagaaaaggctcactagacgtcaaagctgttgcctcccgtgcaactgaagtttccagccagagacgacactcttccatggcccggatacattccatgacaattgaggcgcccatcaccaaggtaatcaatattatcaatgctgcccaggaaagtagtcccatgcctgtgacagaagccctagaccgtgtgctggaaattctaagaaccactgagttatattcaccacagtttggtgctaaagatgatgatccccatgccaatgaccttgttgggggcttaatgtctgatggtttgcgaagactatcagggaatgaatatgttctttcaacaaaaaacactcaaatggtttcaagcaatataatcactcccatctcccttgatgatgtcccaccacggatagctcgggccatggaaaatgaggaatactgggactttgatatttttgaactggaggctgccacccacaataggcctttgatttatcttggtctcaaaatgtttgctcgctttggaatctgtgaattcttacactgctccgagtcaacgctaagatcatggttacaaattatcgaagccaattatcattcctccaatccctaccacaattctacacattctgctgatgtgcttcatgccactgcctattttctctccaaggagaggataaaggaaactttagatccaattgatgaggtcgctgcactcatcgcagccaccattcatgatgtggatcaccctgggagaaccaactccttcctgtgtaatgctggaagtgagctggccattttgtacaatgacactgctgtgctggagagccaccatgcggccttggccttccagctgaccactggagatgataaatgcaatatatttaaaaacatggagaggaatgattatcggacactgcgccaggggattatcgacatggtcttagccacagaaatgacaaagcactttgagcatgtcaacaaatttgtcaacagcatcaacaaacccttggcaacactagaagaaaatggggaaactgataaaaaccaggaagtgataaacactatgcttaggactccagagaaccggaccctaatcaaacgaatgctgattaaatgtgctgatgtgtccaatccctgccgacccctgcagtactgcatcgagtgggctgcacgcatttcggaagaatatttttctcagactgatgaagagaagcagcagggcttacctgtggtgatgccagtgtttgacagaaatacctgcagcatccccaaatcccaaatctctttcattgattacttcatcacagacatgtttgatgcttgggatgcctttgtagacctgcctgatttaatgcagcatcttgacaacaactttaaatactggaaaggactggacgaaatgaagctgcggaacctccgaccacctcctgaatagtgggagacaccacccagagccctgaagctttgttccttcggtcatttggaattcctgagggcagccagagctccttggtcctttcagtactaggcagaacagcccccgatctgcatagcctgtgaaagcccacggggacatcagtaaccttctgcagccaccatccaatgccattactgtcaagtgagacttggccactgtagcctgggcctgctgcaggagctcttcagaaaggcacatgaggaccacggtttgcctcagtttctggtaaaacacaaggtctggagtgcccctgcaaagggtattgatggacttcctgccagtgacagagcatgtctattgcaaacaattctctcagttacgttcagcacttaagaacggctaatggcaataggatctttagcaactttttcacatcatagaaggtgcaatcgctcacttgggaacactactgagagtgacttctcttttaaaattgagtagcagatgaaaaattaaaatttgaacttgattattaatatcaattaaaatgttttatttattttattaaaagctcaatattttctatgaattcaaaaatacttcagagccaaagccaacttcaaataccgtgaccaaatttacatgattcatattcattatgcattacttggtatacagacttattttcataatgcaaattaataaaatgacacttttactgcactatagaaatattcatgtatgttaaacttttctgattgaggctaactggaaaaagctggggtcgtattctaagtgctaaagaaggctgcttctactgtatagaacccagggctctgaaacagctctagccgcctaatgcacttcacaggtaactccccaaggtaaaactagactctcttgttggttcgcaaagaaaagttaggacttaacacttttttctaaaattttataattcaatttccaaaagtctactctattttatactgtttctacaaaatattccttataaaaacaaagaacaaaaattgaatatttaatgaattgacattttataaccaacctgtttttatctacggtgggaatctttgatgccagaaatttataaagaggttctgtatcttcacaccttgaataagcataataccataaaaaatgacacttgacatgtcaatgtatttgtcatttcattttaaactcgtatttgtggtttttttcccagataaaaatgaaattaaaccatttctttttaagaaa

SEQ ID NO: 22318 - DNA, 5956 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatcctcacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatttttcactcccaacagctgtttttattttacctctttggcctaaagttttcataatttcaaatttggggtttagtgtcctttatttcatgagtcacacactttgttttcagagcacattaaaatcaggatgccagaatcccatattaaggacctagctaacttgcctaggcttcagaagcttgcttgaggcaaggacaatctttttctgatcatctcactttcagttctatttggtaagtaacatttatcaggtgtcagacatcttctatatgaaatatttacagcttactcagttttatgtcaaatttcttgttaacttcaaactttttattagtaatgtgcaaatgtttaaaaatgctttaagacagctaggtactaaagcgtcaacaatttctgctctttaccagtgtaatctacggtataatcttctggcctgcgaactagtctattcttccacatagtcaacttgttagaaatacaggctttcagatgatatgtgtatcagatagtttatattatataaactattataactgcctcttacacagagttgtttacttaaatgtcatgtgctgaggagggccgtattaggaaaatgcaacactctctaataatttccgtgactagtaagagaaggaagccagttataaaacactgctggaccagaatgaccctataatttcctaagatcattctttatttctaatttaagatttttaaatttacttgccctccatgtcaggactggttagcattctgggcaaaaaaaaaacaagcctgtcagttcactcagaacctactcagctttagagagagaaacagaagggatgatcttgtgcccttgcgctatgtgaatatagccagagactgaggtaataaatatattttaaaataaaaatgacaagggatttgtacactgtaacactatgtagtgttacttctgctgttgcaagtatcttaactgttgaaagctaaactcaggaaatggagaaaatgtacataatatacattgacccattattttattctaaattgaaagtccaacttttagcagcagtctacctgcaactactgaacaccatcaggtttgagtccctaccagaatctcccatcatactgttatcccccatctctgtgaccttagggcatgcatgaaaacaaaagcaatctagtccctagggttggagactgccctctagacagtttttcatggcagaaaattagaatacaagtatacctcattttattgcattctgcttcattgtgcttcaaagatactgccttttctacaaattgagggcttgtggccaccctgcatagagcaagtctatcggggcattttcccagcatgggctcactttgtgtaagtgtcacattttggtaactcttagagtatttcaaatgtttttattcttgtatctgtcatggtggtctgtgatcagtgatctttgttactactgtaattgttttagggtactgcaaaccatgcccgtataagacagtgaacttaattgataaatcttgtgtatattctaactgttccaccaactagcggtttccagtctctccctcttcttagacctccctattccctgagacacaacaatatcga

SEQ ID NO: 22319 - DNA, 2572 bp, Homo sapiens
atgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttc

SEQ ID NO: 22320 - DNA, 3426 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatcctcacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaa

SEQ ID NO: 22321 - DNA, 2677 bp, Homo sapiens
atgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagtatgtcaacccagccttcgaaaggatgatgggctaccacaaaggtgagctcctgggaaaagaactcgctgatctgcccaaaagcgataagaaccgggcagaccttctcgacaccatcaatacatgcatcaagaagggaaaggagtggcagggggtttactatgccagacggaaatccggggacagcatccaacagcacgtgaagatcaccccagtgattggccaaggagggaaaattaggcattttgtctcgctcaagaaactgtgttgtaccactgacaataataagcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatcctcacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttc

SEQ ID NO: 22322 - DNA, 3276 bp, Homo sapiens
gcggccgcgggcgcgggcgggcgcgcgggggagcccggccgagggatgggctgcgcccccagcatccatgtctcgcagagcggcgtgatctactgccgggactcggacgagtccagctcgccccgccagaccaccagcgtgtcgcagggcccggcggcacccctgcccggcctcttcgtccagaccgacgccgccgacgccatccccccgagccgcgcgtcgggaccccccagcgtagcccgcgtccgcagggcccgcaccgagctgggcagcggtagcagcgcgggttccgcagcccccgccgcgaccaccagcaggggccggaggcgccactgctgcagcagcgccgaggccgagactcagacctgctacaccagcgtgaagcaggtgtcttctgcggaggtgcgcatcgggcccatgagactgacgcaggaccctattcaggttttgctgatctttgcaaaggaagatagtcagagcgatggcttctggtgggcctgcgacagagctggttatagatgcaatattgctcggactccagagtcagcccttgaatgctttcttgataagcatcatgaaattattgtaattgatcatagacaaactcagaacttcgatgcagaagcagtgtgcaggtcgatccgggccacaaatccctccgagcacacggtgatcctcgcagtggtttcgcgagtatcggatgaccatgaagaggcgtcagtccttcctcttctccacgcaggcttcaacaggagatttatggagaatagcagcataattgcttgctataatgaactgattcaaatagaacatggggaagttcgctcccagttcaaattacgggcctgtaattcagtgtttacagcattagatcactgtcatgaagccatagaaataacaagcgatgaccacgtgattcagattcacaagattcatcgtgattcaggagacaattctcagacagagcctcattcattcagatataagaacaggaggaaagagtccattgacgtgaaatcgatatcatctcgaggcagtgatgcaccaagcctgcagaatcgtcgctatccgtccatggcgaggatccactccatgaccatcgaggctcccatcacaaaggttataaatataatcaatgcagcccaagaaaacagcccagtcacagtagcggaagccttggacagagttctagagattttacggaccacagaactgtactcccctcagctgggtaccaaagatgaagatcctcacaccagtgatcttgttggaggcctgatgactgacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaa

SEQ ID NO: 22323 - DNA, 3474 bp, Homo sapiens
gtggcatgctggtgggcatagcttatggggaggtgcttctgccctgttctacctagtcctcaatttggccccatgtccgagtcccttctcctacctcactgccataccatcgtgggtttcctctccagagaatgctgtgaggaaccagtgagtgattccacctcaattttatgtggttttggggaagcggagcgagagaagagcaagtaaaaccaagaatctcttgccatacacacgttacaggcaggacaattgtggctgttgttacttctgtatttactcagtttttaaaattaagctcttggcctaaagatccaacatgtaacttcaggggagtccttcattaattaatactactttaaaccttagcacacatcgtctgggaatgacaaataagcatttctttttttttaaatttaattttattattattatactttaagttttagggtacatgtgcacaacgtgcaggtttgttacatatgtatacatgtgccatgttggtgtgcatttctaaatgacttttaagcaaagatctagatgattgaggtactcagagatcaaaggtggagggaaggaaactgagattcaggaacacttggggactagttcaagagccaggatatggccaagcattggaatttcgtccactctcttaacgctgcatctccaaggacctcaagcccagaaactcttctttaaaaggacggcttgagaagactgtcaggaaacgagtatgtgtttactaagaatgtgcaccagagtcacagtcaccttgcaatgccaataaccatcaatgatgttcccccttgtatctctcaattacttgataatgaggagagttgggacttcaacatctttgaattggaagccattacgcataaaaggccattggtttatctgggcttaaaggtcttctctcggtttggagtatgtgaatttttaaactgttctgaaaccactcttcgggcctggttccaagtgatcgaagccaactaccactcttccaatgcctaccacaactccacccatgctgccgacgtcctgcacgccaccgctttctttcttggaaaggaaagagtaaagggaagcctcgatcagttggatgaggtggcagccctcattgctgccacagtccatgacgtggatcacccgggaaggaccaactctttcctctgcaatgcaggcagtgagcttgctgtgctctacaatgacactgctgttctggagagtcaccacaccgccctggccttccagctcacggtcaaggacaccaaatgcaacattttcaagaatattgacaggaaccattatcgaacgctgcgccaggctattattgacatggttttggcaacagagatgacaaaacactttgaacatgtgaataagtttgtgaacagcatcaacaagccaatggcagctgagattgaaggcagcgactgtgaatgcaaccctgctgggaagaacttccctgaaaaccaaatcctgatcaaacgcatgatgattaagtgtgctgacgtggccaacccatgccgccccttggacctgtgcattgaatgggctgggaggatctctgaggagtattttgcacagactgatgaagagaagagacagggactacctgtggtgatgccagtgtttgaccggaatacctgtagcatccccaagtctcagatctctttcattgactacttcataacagacatgtttgatgcttgggatgcctttgcacatctgccagccctgatgcaacatttggctgacaactacaaacactggaagacactagatgacctaaagtgcaaaagtttgaggcttccatctgacagctaaagccaagccacagagggggcctcttgaccgacaaaggacactgtgaatcacagtagcgtaaacgagaggccttcctttctaatgacaatgacaggtattggtgaaggagctaatgtttaatatttgaccttgaatcattcaagtccccaaatttcattcttagaaagttatgttccatgaagaaaaatatatgttcttttgaatacttaatgacagaacaaatacttggcaaactcctttgctctgctgtcatcctgtgtacccttgtcaatccatggagctggttcactgtaactagcaggccacaggaagcaaagccttggtgcctgtgagctcatctcccaggatggtgactaagtagcttagctagtgatcagctcatcctttaccataaaagtcatcattgctgtttagcttgactgttttcctcaagaacatcgatctgaaggattcataaggagcttatctgaacagatttatctaagaaaaaaaaaaaacgacataaaataagtgaaacaactaggaccaaattacagataaactagttagcttcacagcctctatggctacatggttcttctggccgatggtatgacacctaagttagaacacagccttggctggtgggtgccctctctagactggtatcagcagcctgtgtaacccctttcctgtaaaaggggttcatcttaacaaagtcatccatgatgagggaaaaagtggcatttcatttttggggaatccatgagcttcctttatttctggctcacagaggcagccacgaggcactacaccaagtattatataaaagccattaaatttgaatgcccttggacaagcttttcttaaaaaaaaaaaaaaaaagtttatatacatgtttaaaatttttattaaaatccaaattttctgggtgtaagcccatgcagtatgttgtgccatgcaccatctatacgtaatattttgggaggggataggggaagtttcaaggttcagatatttttaaccagtctatatttgaaatcatgccattagctttaacaatgttaaaattgtgtggtgtaaatatatcagaaaataggcatatggggaggcagtaaatactattttaagctattaattgtatgctaaaagcttctaaagcacaagtgcatatttttatactgctcttttcacaactccctgtgatctacataaagtcagactcgagattttcctttctcttttaccagctgatccttcctatgtattataaatattagactccgtaaacaaacttcatttttctttctctgtacttcatgctgcatttttaaaaggtataaacaaacagagactgaattaattgaatcagtaattacttttttccaatacaaattggaatgcagaatacttggaacttgtacatggggaaaaaatgacttatcactacataatgtgccaatgtttttttctatgttttgtaccaaaaatggaaaaatatgacaattccatgcaaagaaatgtatctaaattatttttgttagatgataagagaacttgcttggtcaggacagcagccagctttgtattgtaatgctatattatgtaaatgtgatgaaaatgtttttgtgaagtacttgtaactaaattcctacagccatt

SEQ ID NO: 22324 - DNA, 2058 bp, Homo sapiens
cgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22325 - DNA, 1956 bp, Homo sapiens
acagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcgcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22326 - DNA, 1728 bp, Homo sapiens
acagtaaaaagtccgagtgcagccgccgggcgcaggatgggatccggctcctccagctaccggcccaaggccatctacctggacatcgatggacgcattcagaaggaacacgaccatctccctgctgaccaccgacgacgccatggtctccatcgaccccaccatgcccgcgaattcagaacgcactccgtacaaagtgagacctgtggccatcaagcaactctccgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22327 - DNA, 1883 bp, Homo sapiens
cctcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22328 - DNA, 1616 bp, Homo sapiens
ggatgggatccggctcctccagctaccggcccaaggccatctacctggacatcgatggacgcattcagaagcactccgtacaaagtgagacctgtggccatcaagcaactctccgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22329 - DNA, 1875 bp, Homo sapiens
acagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacggaatgagctcattctctatacatcactccgtaacttgttgtttttacctagtaaggagtcatgggcgtcccaccagcactccgtacaaagtgagacctgtggccatcaagcaactctccgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22330 - DNA, 1671 bp, Homo sapiens
ggatgggatccggctcctccagctaccggcccaaggccatctacctggacatcgatggacgcattcagaagcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22331 - DNA, 1963 bp, Homo sapiens
acagtaaaaagtccgagtgcagccgccgggcgcaggatgggatccggctcctccagctaccggcccaaggccatctacctggacatcgatggacgcattcagaaggaacacgaccatctccctgctgaccaccgacgacgccatggtctccatcgaccccaccatgcccgcgaattcagaacgcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22332 - DNA, 1606 bp, Homo sapiens
acagtaaaaagtccgagtgcagccgccgggcgcaggatgggatccggctcctccagctaccggcccaaggccatctacctggacatcgatggacgcattcagaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22333 - DNA, 1684 bp, Homo sapiens
acagtaaaaagtccgagtgcagccgccgggcgcaggatgggatccggctcctccagctaccggcccaaggccatctacctggacatcgatggacgcattcagaaggaacacgaccatctccctgctgaccaccgacgacgccatggtctccatcgaccccaccatgcccgcgaattcagaacgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22334 - DNA, 1885 bp, Homo sapiens
acagtaaaaagtccgagtgcagccgccgggcgcaggatgggatccggctcctccagctaccggcccaaggccatctacctggacatcgatggacgcattcagaagcactccgtacaaagtgagacctgtggccatcaagcaactctccgctggtgtcgaggacaagagaaccacaagccgtggccagtctgctgagagaccactgagggacagacgggttgtgggcctggagcagccccggagggaaggagcatttgaaagtggacaggtagagcccaggcccagagagccccagggctgctaccaggaaggccagcgcatccctccagagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22335 - DNA, 1783 bp, Homo sapiens
acagtaaaaagtccgagtgcagccgccgggcgcaggatgggatccggctcctccagctaccggcccaaggccatctacctggacatcgatggacgcattcagaaggaacacgaccatctccctgctgaccaccgacgacgccatggtctccatcgaccccaccatgcccgcgaattcagaacgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22336 - DNA, 1776 bp, Homo sapiens
acagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcgcactccgtacaaagtgagacctgtggccatcaagcaactctccgagagagaagaattaatccagagcgtgctggcgcaggttgcagagcagttctcaagagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacggaaa

SEQ ID NO: 22337 - DNA, 1779 bp, Homo sapiens
tcccgcggcggctggcgtcgggaaagtacagtaaaaagtccgagtgcagccgccgggcgcaggatgggatccggctcctccagctaccggcccaaggccatctacctggacatcgatggacgcattcagaaggtaatcttcagcaagtactgcaactccagcgacatcatggacctgttctgcatcgccaccggcctgcctcggaacacgaccatctccctgctgaccaccgacgacgccatggtctccatcgaccccaccatgcccgcgaattcagaacgagcattcaaaatcaatgaactgaaagctgaagttgcaaatcacttggctgtcctagagaaacgcgtggaattggaaggactaaaagtggtggagattgagaaatgcaagagtgacattaagaagatgagggaggagctggcggccagaagcagcaggaccaactgcccctgtaagtacagttttttggataaccacaagaagttgactcctcgacgcgatgttcccacttaccccaagtacctgctctctccagagaccatcgaggccctgcggaagccgacctttgacgtctggctttgggagcccaatgagatgctgagctgcctggagcacatgtaccacgacctcgggctggtcagggacttcagcatcaaccctgtcaccctcaggaggtggctgttctgcgtccacgacaactacagaaacaaccccttccacaacttccggcactgcttctgcgtggcccagatgatgtacagcatggtctggctctgcagtctccaggagaagttctcacaaacggatatcctgatcctaatgacagcggccatctgccacgatctggaccatcccggctacaacaacacgtaccagatcaatgcccgcacagagctggcggtccgctacaatgacatctcaccgctggagaaccaccactgcgccgtggccttccagatcctcgccgagcctgagtgcaacatcttctccaacatcccacctgatgggttcaagcagatccgacagggaatgatcacattaatcttggccactgacatggcaagacatgcagaaattatggattctttcaaagagaaaatggagaattttgactacagcaacgaggagcacatgaccctgctgaagatgattttgataaaatgctgtgatatctctaacgaggtccgtccaatggaagtcgcagagccttgggtggactgtttattagaggaatattttatgcagagcgaccgtgagaagtcagaaggccttcctgtggcaccgttcatggaccgagacaaagtgaccaaggccacagcccagattgggttcatcaagtttgtcctgatcccaatgtttgaaacagtgaccaagctcttccccatggttgaggagatcatgctgcagccactttgggaatcccgagatcgctacgaggagctgaagcggatagatgacgccatgaaagagttacagaagaagactgacagcttgacgtctggggccaccgagaagtccagagagagaagcagagatgtgaaaaacagtgaaggagactgtgcctgaggaaagcggggggcgtggctgcagttctggacgggctggccgagctgcgcgggatccttgtgcagggaagagctgccctgggcacctggcaccacaagaccatgttttctaagaaccattttgttcactgatacaaaaaaaaaaaaaggaattcatgatgctgtacagaattttatttttaaactgtcttttaaataatatattcttatacgg

SEQ ID NO: 22338 - DNA, 2686 bp, Homo sapiens
atttaaagctgggaggttctgccaccaagcacggccttcccactgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctaccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactgctggttggctctcactgaccccagggatgtggccaggatcgaaagcaagacggttatcgtcacccaagagcaaagagacacagtgcccatccccaaaacaggcctcagccagctcggtcgctggatgtcagaggaggattttgagaaagcgttcaatgccaggttcccagggtgcatgaaaggtcgcaccatgtacgtcatcccattcagcatggggccgctgggctcgcctctgtcaaagatcggcatcgagctgacggattcaccctacgtggtggccagcatgcggatcatgacgcggatgggcacgcccgtcctggaagcagtgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggtgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaacactgggtagtagctaatgaaattgagaagggaaatcttagcatgcctccaaaaattcacatccaatgcatagtttgttcaaatttaaggttactcaggcattgatcttttcagtgttttttcactttagctatgtggattagctagaatgcacaccaaaaaaatacttgagctgtatatatatatgtgtgtgtgtgtgtgtgtgtgtgtgtgtgtgtgtgcatgtatgtgcacatgtgtctgtgtggtatatttgtgtatgtgtatttgtatgtactgttattgaaaatatatttaatacctttggaaaaatcttgggcaagatgacctactagttttccttgaaaaaaagttgctttgttattaatattgtgcttaaattatttttatacaccattgttccttacctttacataattgcaatatttcccccttactacttcttggaaaaaaattacaaaatgaagttttatagaaaaga

SEQ ID NO: 22339 - DNA, 1358 bp, Homo sapiens
ctgagctgtgtcagcctgatcacatccacatctgtgacggctctgaggaggagaatgggcggcttctgggccagatggaggaagagggcatcctcaggcggctgaagaagtatgacaactggtcgcaccatgtacgtcatcccattcagcatggggccgctgggctcgcctctgtcaaagatcggcatcgagctgacggattcaccctacgtggtggccagcatgcggatcatgacgcggatgggcacgcccgtcctggaagcagtgggcgatggggagtttgtcaaatgcctccattctgtggggtgccctctgcctttacaaaagcctttggtcaacaactggccctgcaacccggagctgacgctcatcgcccacctgcctgaccgcagagagatcatctcctttggcagtgggtacggcgggaactcgctgctcgggaagaagtgctttgctctcaggatggccagccggctggccaaggaggaagggtggctggcagagcacatgctgattctgggtataaccaaccctgagggtgagaagaagtacctggcggccgcatttcccagcgcctgcgggaagaccaacctggccatgatgaaccccagcctccccgggtggaaggttgagtgcgtcggggatgacattgcctggatgaagtttgacgcacaaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggtgtcaccatcacgtcctggaagaataaggagtggagctcagaggatggtgtgtccctgccagaggccttggtgtgccgggctgcagggactgcctgtttgagccaggcactcacgagcctttctctgtcttataggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccgga

SEQ ID NO: 22340 - DNA, 915 bp, Homo sapiens
acaacaggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggtgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaa

SEQ ID NO: 22341 - DNA, 1439 bp, Homo sapiens
acggccttcccactgggaacacaaacttgctggcgggaagagcccggaaagaaacctgtggatctcccttcgagatcatccaaagagaagaaaggtgacctcacattcgtgccccttagcagcactctgcagaaatgcctcctcagctgcaaaacggcctgaacctctcggccaaagttgtccagggaagcctggacagcctaccccaggcagtgagggagtttctcgagaataacgctgagctgtgtcagcctgatcacatccacatctgtgacggctctgaggaggagaatgggcggcttctgggccagatggaggaagagggcatcctcaggcggctgaagaagtatgacaactggtcatttaagggccatcaacccagaaaatggctttttcggtgtcgctcctgggacttcagtgaagaccaaccccaatgccatcaagaccatccagaagaacacaatctttaccaatgtggccgagaccagcgacgggggcgtttactgggaaggcattgatgagccgctagcttcaggtgtcaccatcacgtcctggaagaataaggagtggagctcagaggatggggaaccttgtgcccaccccaactcgaggttctgcacccctgccagccagtgccccatcattgatgctgcctgggagtctccggaaggtgttcccattgaaggcattatctttggaggccgtagacctgctggtgtccctctagtctatgaagctctcagctggcaacatggagtctttgtgggggcggccatgagatcagaggccacagcggctgcagaacataaaggcaaaatcatcatgcatgacccctttgccatgcggcccttctttggctacaacttcggcaaatacctggcccactggcttagcatggcccagcacccagcagccaaactgcccaagatcttccatgtcaactggttccggaaggacaaggaaggcaaattcctctggccaggctttggagagaactccagggtgctggagtggatgttcaaccggatcgatggaaaagccagcaccaagctcacgcccataggctacatccccaaggaggatgccctgaacctgaaaggcctggggcacatcaacatgatggagcttttcagcatctccaaggaattctgggagaaggaggtggaagacatcgagaagtatctggaggatcaagtcaatgccgacctcccctgtgaaatcgagagagagatccttgccttgaagcaaagaataagccagatgtaatcagggcctgagtgctttacctttaaaatcattccctttcccatccataaggtgcagtaggagcaagagagggcaagtgttcccaaattgacgccaccataataatcatcaccacaccgtgagcagatctgaaaggcacactttgatttttttaaggataagaaccacagaac

SEQ ID NO: 22342 - DNA, 2357 bp, Homo sapiens
ggcggtttggaggcaggggttggggcggcggctgggctgacctggagcctggagccccggggccgagggagctggcctgccagcggggcggaggaaagctagtgccagccctaccaggttccgcccccgcgcctgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtacaactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctattttacacaa

SEQ ID NO: 22343 - DNA, 1830 bp, Homo sapiens
ggggcggcggctgggctgacctggagcctggagccccggggccgagggagctggcctgccagcggggcggaggaaagctagtgccagccctaccaggttccgcccccgcgcctgcccccctcctttttaagcgcctcccgccagcctctgctgtggctcgcttcgccgcgctccctccttccccgccttccatacctccccggctccgctcggttcctggccaccccgcagcccctgcccaggtgccatggccgcattgtaccgccctggcctgcggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtacaactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtatgtgcggtggggaaggtgtggcacagcctccaggcctcagcaccttaatggtggaaaagctttctccacaacctccaaccatcttctaggactgccaggaggcacagaagtcatgaacgtttgcagtttccagtcccaggcaaaatctcagttcatgtcccaactccaccagtcactggttttgtgatctggctaagttgctcaacttccctaagctttagtttccacatcagttgaatgagggtagttgtgatagtacctatctcatgagattgttggaggattaaatagtgcataaaaagggtttatcacactgacaaatacacagtaaattctcaataataaa

SEQ ID NO: 22344 - DNA, 2505 bp, Homo sapiens
agcctctgctgtggctcgcttcgccgcgctccctccttccccgccttccatacctccccggctccgctcggttcctggccaccccgcagcccctgcccaggtgccatggccgcattgtaccgccctggcctgcggtgagtgacccccggcccggggcccacccgcaccttccgctgcgctcgccccctcggggctgccagtggcgctctcctgctctcagcctccgccaggtttcccatcctaggcggaggcgggcaggggcgactgctgtgggtccagcctcccgcgccgcgcgtctcttgggagggcagccggccggtgctcctcgtttccgcctgcacctccccttctctgcctcgctcgcctctgaccgcgcgatctctatctgccactctcagaacttcctctctctcctcgctcctctctgctgagccaggtctccgcatatcctcctttccttcccagatacctccctcggacctctaacgggctctcagccagcgccccagggtacttcgagaggcagcagggccctggggacaagggcttaactggcatgggctgagccccttgggctggccatcatgccgtagcatccagaccctgcgagtgcttagtggagatctgggccagcttcccactggcattcgagattttgtagagcacagtgcccgcctgtgccaaccagagggcatccacatctgtgatggaactgaggctgagaatactgccacactgaccctgctggagcagcagggcctcatccgaaagctccccaagtacaataactgctggctggcccgcacagaccccaaggatgtggcacgagtagagagcaagacggtgattgtaactccttctcagcgggacacggtacaactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcag

SEQ ID NO: 22345 - DNA, 2012 bp, Homo sapiens
gtggctcgcttcgccgcgctccctccttccccgccttccatacctccccggctccgctcggttcctggccaccccgcagcccctgcccaggtgccatggccgcattgtaccgccctggcctgcgatacctccctcggacctctaacgggctctcagccagcgccccagggtacttcgagaggcagcagggccctggggacaaggctggctggcccgcacagaccccaaggatgtggcacgagtagagagcaagacggtgattgtaactccttctcagcgggacacggtacaactcccgcctggtggggcccgtgggcagctgggcaactggatgtccccagctgatttccagcgagctgtggatgagaggtttccaggctgcatgcagggccgcaccatgtatgtgcttccattcagcatgggtcctgtgggctccccgctgtcccgcatcggggtgcagctcactgactcagcctatgtggtggcaagcatgcgtattatgacccgactggggacacctgtgcttcaggccctgggagatggtgactttgtcaagtgtctgcactccgtgggccagcccctgacaggacaaggggagccagtgagccagtggccgtgcaacccagagaaaaccctgattggccacgtgcccgaccagcgggagatcatctccttcggcagcggctatggtggcaactccctgctgggcaagaagtgctttgccctacgcatcgcctctcggctggcccgggatgagggctggctggcagagcacatgctgatcctgggcatcaccagccctgcagggaagaagcgctatgtggcagccgccttccctagtgcctgtggcaagaccaacctggctatgatgcggcctgcactgccaggctggaaagtggagtgtgtgggggatgatattgcttggatgaggtttgacagtgaaggtcgactccgggccatcaaccctgagaacggcttctttggggttgcccctggtacctctgccaccaccaatcccaacgccatggctacaatccagagtaacactatttttaccaatgtggctgagaccagtgatggtggcgtgtactgggagggcattgaccagcctcttccacctggtgttactgtgacctcctggctgggcaaaccctggaaacctggtgacaaggagccctgtgcacatcccaactctcgattttgtgccccggctcgccagtgccccatcatggacccagcctgggaggccccagagggtgtccccattgacgccatcatctttggtggccgcagacccaaaggggtacccctggtatacgaggccttcaactggcgtcatggggtgtttgtgggcagcgccatgcgctctgagtccactgctgcagcagaacacaaagggaagatcatcatgcacgacccatttgccatgcggcccttttttggctacaacttcgggcactacctggaacactggctgagcatggaagggcgcaagggggcccagctgccccgtatcttccatgtcaactggttccggcgtgacgaggcagggcacttcctgtggccaggctttggggagaatgctcgggtgctagactggatctgccggcggttagagggggaggacagtgcccgagagacacccattgggctggtgccaaaggaaggagccttggatctcagcggcctcagagctatagacaccactcagctgttctccctccccaaggacttctgggaacaggaggttcgtgacattcggagctacctgacagagcaggtcaaccaggatctgcccaaagaggtgttggctgagcttgaggccctggagagacgtgtgcacaaaatgtgacctgaggccctagtctagcaagaggacatagcaccctcatctgggaatagggaaggcaccttgcagaaaatatgagcaatttgatattaactaacatcttcaatgtgccatagaccttcccacaaagactgtccaataataagagatgcttatctatttt

SEQ ID NO: 22346 - DNA, 2912 bp, Homo sapiens
gcgacgcggcgcaggcggcgggagtgcgagctgggcccgtgtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccggagagca

SEQ ID NO: 22347 - DNA, 1108 bp, Homo sapiens
cgtgtttcggccgccgccatggccgcggtggacctggagaagctgcgggcgtcgggcgcgggcaaggccatcggcgtcctgaccagcggcggcgacgcgcaaggtcccctgacaagcccaccaggccccctgctgagatggctgtgaccctgggctgacccgcccagtggcacattgactccgcctggagctggggagaccagagaggccctgtggttggacggtggcctgggtgcgctgctcctgccctctccttgccctgcctcagctgctgcctgccagaggcgtggcacctcacctcacacctgctccctgctgctgagccccacgccaagctggagagcggatgagaagcatgtgtaaccagggtagaggtcgagagtcctctcgtgggggtctccatgttcaagggagctgccgaggcttgagcaggagcccccagcaggaaactggctttgccaaggcccccgctgggacagactgtttctttcactgcagtcctgggagccgagggcaaggggacaggaaagaggaagtgacctcagagcctggtggcaccagcatcatgtccaggctggggggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccacccgaggacggctgggagaacttcatgtgtga

SEQ ID NO: 22348 - DNA, 2992 bp, Homo sapiens
atgtgtaaccagggtagaggtcgagagtcctctcgtgggggtctccatgttcaagggagctgccgaggcttgagcaggagcccccagcaggaaactggctttgccaaggcccccgctgggacagactgtttctttcactgcagtcctgggagccgagggcaaggggacaggaaagaggaagtgacctcagagcctggtggcaccagcatcatgtccaggctggggggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccagggaggggcgccgggcagcggcctacaacctggtccagcacggcatcaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccgg

SEQ ID NO: 22349 - DNA, 2815 bp, Homo sapiens
gtttcggccgccgccatggccgcggtggacctggagaagctgcgggcgtcgggcgcgggcaaggccatcggcgtcctgaccagcggcggcgacgcgcaaggcatgaacgctgctgtccgggctgtgacgcgcatgggcatttatgtgggtgccaaagtcttcctcatctacgagggctatgagggcctcgtggagggaggtgagaacatcaagcaggccaactggctgagcgtctccaacatcatccagctgggcggcactatcattggcagcgctcgctgcaaggcctttaccaccaacctgtgcgtcatcggcggggatggcagcctcacaggtgccaacatcttccgcagcgagtggggcagcctgctggaggagctggtggcggaaggtaagatctcagagactacagcccggacctactcgcacctgaacatcgcgggcctagtgggctccatcgataacgacttctgcggcaccgacatgaccatcggcacggactcggccctccaccgcatcatggaggtcatcgatgccatcaccaccactgcccagagccaccagaggaccttcgtgctggaagtgatgggccggcactgcgggtacctggcgctggtatctgcactggcctcaggggccgactggctgttcatccccgaggctccacccgaggacggctgggagaacttcatgtgtgagaggctgggtgagactcggagccgtgggtcccgactgaacatcatcatcatcgctgagggtgccattgaccgcaacgggaagcccatctcgtccagctacgtgaaggacctggtggttcagaggctgggcttcgacacccgtgtaactgtgctgggccacgtgcagcggggagggacgccctctgccttcgaccggatcctgagcagcaagatgggcatggaggcggtgatggcgctgctggaagccacgcctgacacgccggcctgcgtggtcaccctctcggggaaccagtcagtgcggctgcccctcatggagtgcgtgcagatgaccaaggaagtgcagaaagccatggatgacaagaggtttgacgaggccacccagctccgtggtgggagcttcgagaacaactggaacatttacaagctcctcgcccaccagaagccccccaaggagaagtctaacttctccctggccatcctgaatgtgggggccccggcggctggcatgaatgcggccgtgcgctcggcggtgcggaccggcatctcccatggacacacagtatacgtggtgcacgatggcttcgaaggcctagccaagggtcaggtgcaagaagtaggctggcacgacgtggccggctggttggggcgtggtggctccatgctggggaccaagaggaccctgcccaagggccagctggagtccattgtggagaacatccgcatctatggtattcacgccctgctggtggtcggtgggtttgaggcctatgaaggggtgctgcagctggtggaggctcgcgggcgctacgaggagctctgcatcgtcatgtgtgtcatcccagccaccatcagcaacaacgtccctggcaccgacttcagcctgggctccgacactgctgtaaatgccgccatggagagctgtgaccgcatcaaacagtctgcctcggggaccaagcgccgtgtgttcatcgtggagaccatggggggttactgtggctacctggccaccgtgactggcattgctgtgggggccgacgccgcctacgtcttcgaggaccctttcaacatccacgacttaaaggtcaacgtggagcacatgacggagaagatgaagacagacattcagaggggcctggtgctgcggaacgagaagtgccatgactactacaccacggagttcctgtacaacctgtactcatcagagggcaagggcgtcttcgactgcaggaccaatgtcctgggccacctgcagcagggtggcgctccaaccccctttgaccggaactatgggaccaagctgggggtgaaggccatgctgtggttgtcggagaagctgcgcgaggtttaccgcaagggacgggtgttcgccaatgccccagactcggcctgcgtgatcggcctgaagaagaaggcggtggccttcagccccgtcactgagctcaagaaagacactgatttcgagcaccgcatgccacgggagcagtggtggctgagcctgcggctcatgctgaagatgctggcacaataccgcatcagtatggccgcctacgtgtcaggggagctggagcacgtgacccgccgcaccctgagcatggacaagggcttctgaggccagccatgcccacgcccctccccagcccccacccatgccagcgcagcgccagggctcagatggggcctgggctgttgtgtctggagcctgcaggcaggtgggggctgcgtccctgctcagcccatcccctgcctctatccctggccacctgccaggcctccctcgggctggtgtcttgagaccagcctgccaggccctccagcaggaggacagagtgccctggggcatccaccttcctgcccaggggacgtggcgctgtcggtgtttggaggctgctgccccctggctttggcgccccatgggccctcagcgtctccccatgctgggctcactacatgggccagcccttgctctacctggccggtaggctgctggcgcctaggttgtgttgagagggggatgcccctggccctgcctcactgtgacctgctcctgcccacgtgcagcacctgtcaccttttctagaaataaaatcaccctgactgtggggtgcatcggtctccgg

SEQ ID NO: 22350 - DNA, 3078 bp, Homo sapiens
agacttggtatagtgggagagcctgactgagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtgcttttgcttctcctgttatcatcttcctaagtggaatgtaatactgtcagccccatgtatcagacacttgtctgatgaagcagtaaagacgttaagggtatcacagggggtggaggaagggattatctctagtacactacttgctggctgtctgaaaaattgtcactgccaaactctaaaaacagttctaaatagtgactgagaaggtttgttgctggagtcagggaataaggcagccaaatactctttgcacagttctttagtgggaagagaaattaacaataaatatcaagcactgtg

SEQ ID NO: 22351 - DNA, 3176 bp, Homo sapiens
gcttccgcccagtccagcccgggccggctgaccgggtccgacacagtctcctggaccaggctccctccatcctcacccctcccccagcttcccgccgccactcaccgaaccggaaccggctgccatgcgaaggggtttccggccgggcgcggaacgcaaaacccgggaaccgccgcgaaccggaaccgccttcacagcaccggaagagtcgctaggaggcagccatgcataaagacgagtttcatctgaaatttttcatgtgtgtgattcagtctcgccagttagtcaggactcctcagagaacagctggggaagcttctacttccagcatgctcataccaaagccaccaccaaagacagacatcttgaagagtctagatactatggatgatccagacaccgtgggaagcatacctgttttcaaaactgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 22352 - DNA, 2928 bp, Homo sapiens
aagcaggaggaggcggagccttcttgtcagcatctgttagtggaggttgggaagcctctcctccttccccctccctctttgcctccacctggctcctccccatgttcgtccatcacccctcccccctttcccaaggacaatctgcaagaaagcagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 22353 - DNA, 2683 bp, Homo sapiens
cagcggcggaggagagctaagactaaaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 22354 - DNA, 585 bp, Homo sapiens
atcttgattcctgctgtgtcttaactgaccattgtcttaaattctagagtggatcatgacccatgaagagcaccatgcagccaaaaccctggggattggcaaagccattgctgtcttaacctctggtggagatgcccaaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctgg

SEQ ID NO: 22355 - DNA, 2867 bp, Homo sapiens
agacttggtatagtgggagagcctgactgaggtggctctagccagtctaattgccgttcctttagctagtggcatcttgattcctgctgtgtcttaactgaccattgtcttaaattctagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatctggtggttaagcgtctgggatatgacacccgggttactgtcttggggcatgtgcagaggggtgggacgccatcagcctttgacagaattctgggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 22356 - DNA, 594 bp, Homo sapiens
tttctgatggtggcactagcgatatcacatctcagggagataccacagagtaggagagttggagaaatgtttacgtgagacgcagaagtagtcaagaaatatcactcgggtctcaaggaaggcgggagatgaagccggtaccacagaaagccgagcttcccggtgaaaacagctctccccagagaagacccagctctggcgggaaagccccggaatcgcaaccggcctttccccaaagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgg

SEQ ID NO: 22357 - DNA, 571 bp, Homo sapiens
atttcagcttgtcagtctacaagggtgtggctttcctctggaagaagtccaaagctctcaggctgcaaagctcagacttgagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctg

SEQ ID NO: 22358 - DNA, 762 bp, Homo sapiens
ggtagtagataaaaggctttatatgaatattacaagaatcaccaccactccaaatataataagtgtaccaaatatgaagtaaaatgactttaacaaggctgacttgaaagtgataaagaagcaagttactgctaacaagatagtggaaatactgcacaggcaccgataaacagaaatcaccaagctcaaggaaagagaaacgaggcatagatccagagatcacgttagggtacaccaagaaagagacggttcaagggaattaccaggaggcgatgagccagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacat

SEQ ID NO: 22359 - DNA, 452 bp, Homo sapiens
accacagaaagccgagcttcccggtgaaaacagctctccccagagaagacccagctctggcgggaaagccccggaatcgcaaccggcctttccccaagtacggctgggcgctgggatggggcctgctgtaacggcagggagacggtctctccgcggcccaggagagagagaccagaaggaacggcctcagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattgg

SEQ ID NO: 22360 - DNA, 526 bp, Homo sapiens
aatctgcaagaaagcagcggcggaggagagctaagactaaaaggcaagaggggccattgagtgaagagcaagggggagagctgggagtgaggtgggaagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctcca

SEQ ID NO: 22361 - DNA, 2797 bp, Homo sapiens
aatatctgtctgtttttgtctacgtgcgtgtcattgtgggtctgtaagggatgcttatacatgagtctgcatgaatttctgtgtcctgtgcctctataactgtcttagagatttcaggagaagaatatgagcggtttttacagagtggatcatgacccatgaagagcaccatgcagccaaaaccctggggattggcaaagccattgctgtcttaacctctggtggagatgcccaaggtatgaatgctgctgtcagggctgtggttcgagttggtatcttcaccggtgcccgtgtcttctttgtccatgagggttatcaaggcctggtggatggtggagatcacatcaaggaagccacctgggagagcgtttcgatgatgcttcagctgggaggcacggtgattggaagtgcccggtgcaaggactttcgggaacgagaaggacgactccgagctgcctacaacctggtgaagcgtgggatcaccaatctctgtgtcattgggggtgatggcagcctcactggggctgacaccttccgttctgagtggagtgacttgttgagtgacctccagaaagcaggtaagatcacagatgaggaggctacgaagtccagctacctgaacattgtgggcctggttgggtcaattgacaatgacttctgtggcaccgatatgaccattggcactgactctgccctgcatcggatcatggaaattgtagatgccatcactaccactgcccagagccaccagaggacatttgtgttagaagtaatgggccgccactgtggatacctggcccttgtcacctctctgtcctgtggggccgactgggtttttattcctgaatgtccaccagatgacgactgggaggaacacctttgtcgccgactcagcgagacaaggacccgtggttctcgtctcaacatcatcattgtggctgagggtgcaattgacaagaatggaaaaccaatcacctcagaagacatcaagaatggcagcaggatgggtgtggaagcagtgatggcacttttggaggggaccccagataccccagcctgtgtagtgagcctctctggtaaccaggctgtgcgcctgcccctcatggaatgtgtccaggtgaccaaagatgtgaccaaggccatggatgagaagaaatttgacgaagccctgaagctgagaggccggagcttcatgaacaactgggaggtgtacaagcttctagctcatgtcagacccccggtatctaagagtggttcgcacacagtggctgtgatgaacgtgggggctccggctgcaggcatgaatgctgctgttcgctccactgtgaggattggccttatccagggcaaccgagtgctcgttgtccatgatggtttcgagggcctggccaaggggcagatagaggaagctggctggagctatgttgggggctggactggccaaggtggctctaaacttgggactaaaaggactctacccaagaagagctttgaacagatcagtgccaatataactaagtttaacattcagggccttgtcatcattgggggctttgaggcttacacagggggcctggaactgatggagggcaggaagcagtttgatgagctctgcatcccatttgtggtcattcctgctacagtctccaacaatgtccctggctcagacttcagcgttggggctgacacagcactcaatactatctgcacaacctgtgaccgcatcaagcagtcagcagctggcaccaagcgtcgggtgtttatcattgagactatgggtggctactgtggctacctggctaccatggctggactggcagctggggccgatgctgcctacatttttgaggagcccttcaccattcgagacctgcaggcaaatgttgaacatctggtgcaaaagatgaaaacaactgtgaaaaggggcttggtgttaaggaatgaaaagtgcaatgagaactataccactgacttcattttcaacctgtactctgaggaggggaagggcatcttcgacagcaggaagaatgtgcttggtcacatgcagcagggtgggagcccaaccccatttgataggaattttgccactaagatgggcgccaaggctatgaactggatgtctgggaaaatcaaagagagttaccgtaatgggcggatctttgccaatactccagattcgggctgtgttctggggatgcgtaagagggctctggtcttccaaccagtggctgagctgaaggaccagacagattttgagcatcgaatccccaaggaacagtggtggctgaaactgaggcccatcctcaaaatcctagccaagtacgagattgacttggacacttcagaccatgcccacctggagcacatcacccggaagcggtccggggaagctgccgtctaaacctctctggagtgaggggaatagattacctgatcatggtcagctcacaccctaataagtccacatcttctcagtgttttagctgtttttttcattaggtttccttttattctgtaccttgcagccatgaccagttctggccaggagctggaggagcaggcagtgggtgggagctccttttaggtagaatttaacatgacttctgccccagctttatctgtcacacaaggctgggcacctctagtgctactgctagatatcacttactcagttagaattttcctaaaaataagctttatttatttctttgtgataacaaagagtcttggttcctctactacttttactacagtgacaaattgtaactacactaataaatgccaactggtcactgtg

SEQ ID NO: 22362 - DNA, 1698 bp, Homo sapiens
gaactggatcagatttatgttttttatagatggggtcctttctgtgtgaacggattggagggtcccggggtgggagctgaggcccaggaagagggcgttgcagccggactgatgtatgggtgggaaggcggccgatgcatttctttgccatttttctccccgccgagcttgggtcctcatggagggcggatggcagacatttcactctgggatccgatgcctgtgcatctggaagacttccccaggtgcctgggtctaagaaccaccatctgcctttgagtagagtttccataaatgtaacattcgccaatggatggaagatggccgcacctctaaaatcacagggagcttttcagaagaaaatagaatagcacagcggttctcacggactaagctggcaggggacagtcccctaacatctcagctaacacctaacggtgtctgtgtccggtgaaagcggcttcagcagggacagtcacagagcagcgtggagtgagctggcttgtggggtcgtcttttccgtccccttctatggggcctgggagaagggagcggcagatggccaggcccccaaaacgggacatcgaggtcacctccaggtggctgccatggtggggttgcgggggaccacgttcacacccactccgagggcacatcctggctgctgcacacccttcacctctgcgggatgctgggaccgcatgtttgggcgcggtgggggggccttgctgcactcactcttgggggagctctgggatggtgggcgcgccccgggcctgggctggagtgactgatcgcttctctgtgaccagacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgccta

SEQ ID NO: 22363 - DNA, 2769 bp, Homo sapiens
atttaacattgaagagcggaaggtggcggagactcggcgcgccccaggccccgggtgcacgtgggggcgccggtgcccggatgatggagtgtcccgatccgtgcaatccctggcggggctgggttctcagagaaagaaaacgtgatgcagcagaggatgggattgaagaaacaggagagtgaagtggaaatagcctggcccgcgtgacttaaaccggcccggagatgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgccta

SEQ ID NO: 22364 - DNA, 2645 bp, Homo sapiens
gagtcaggcgcgcgcgggcagggtccccattgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgccta

SEQ ID NO: 22365 - DNA, 2709 bp, Homo sapiens
attgcctgctgcgcacccggacgtgcggctcccctcggcctcctcgccatggacgcggacgactcccgggcccccaagggctccttgcggaagttcctggagcacctctccggggccggcaaggccatcggcgtgctgaccagcggcggggatgctcaaggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtggtgctgtaaggggtgactggagggagaagcctggctgctggtcacaccgcttcccttgtcctggccggcatgctctggtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcctacctgggactcctggagctgtcagccgcccgggagaagcacgaggagttctgtgtccccatggtcatggttcccgctactgtgtccaacaatgtgccgggttccgatttcagcatcggggcagacaccgccctgaacactatcaccgacacctgcgaccgcatcaagcagtccgccagcggaaccaagcggcgcgtgttcatcatcgagaccatgggcggctactgtggctacctggccaacatgggggggctcgcggccggagctgatgccgcatacattttcgaagagcccttcgacatcagggatctgcagtccaacgtggagcacctgacggagaaaatgaagaccaccatccagagaggccttgtgctcagaaatgagagctgcagtgaaaactacaccaccgacttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagcacaggattcccaaagaacagtggtggctcaagctacggcccctcatgaaaatcctggccaagtacaaggccagctatgacgtgtcggactcaggccagctggaacatgtgcagccctggagtgtctgacccagtcccgcctgcatgtgcctgcagccaccgtggactgtctgtttttgtaacacttaagttattttatcagcactttatgcacgtattattgacattaatacctaatcggcgagtgcccatctgccccacctgctccagtgcgtgctgtctgtggagtgtgtctcatgctttcagatgtgcatatgagcagaattaattaaacatttgcctatgactccaacag

SEQ ID NO: 22366 - DNA, 705 bp, Homo sapiens
ttaaggaagttcacctccagatgtactcagagggcctggtcttagctgccacagatttacaaacccttacagtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacggcccagagccaccagaggaccttcgttctggaggtgatgggacgacactgtgggtacctggccctggtgagtgccttggcctgcggtgcggactgggtgttccttccagaatctccaccagaggaaggctggga

SEQ ID NO: 22367 - DNA, 496 bp, Homo sapiens
tgccgacggccacaggatgctcgccatctatgatggctttgacggcttcgccaagggccagatcaaagaaatcggctggacagatgtcgggggctggaccggccaaggaggctccattcttgggacaaaacgcgttctcccggggaagtacttggaagagatcgccacacagatgcgcacgcacagcatcaacgcgctgctgatcatcggtggattcgaggcttacaagagtgcgtgcgacatggccgaggcacgaggccgccaccaggagctttgcatccccctgtgtgtggtgccggccacgattagcaacaatgtcccaggcacagaaataagcctgggctccgacactggcctgaatgctgttgttgagacctgcgaccgcatcaagcagtccgccagcggaaccaagcggcgcgtgttcatcatcgagaccatgggcggctactgtggctacctggccaacatgggggggctcgcggccggagctgatgcc

SEQ ID NO: 22368 - DNA, 1140 bp, Homo sapiens
gtttccgtgggagagatccagccgtggctgtcgacagcagctgccgactgtgcccaatagagaaggtatctgggaaagagcccagcacggggccggggagtgtgagtgtgtcctggcacaggcaggcagaaggtgtccaacgtgcaactggagagcgcagaggtggctcaagtccccttcctcgcaggagtctggaaggctactgcatagcgtttgccttagtagaaaatggaccatttttgaagcctaggtccctgcaggcctcctggctaactcggctgtcaaagccccttttctctgctttctgagctgtttccaggactgagtgggtgctccctctgtttctctgctttctgagctgtgtccggggctccctctgtttctcttccagccaccagaggaccttcgttctggaggtgatgggacgacactgtgggtacctggccctggtgagtgccttggcctgcggtgcggactgggtgttccttccagaatctccaccagaggaaggctgggaggagcagatgtgtgtcaaactctcggagaaccgtgcccggaaaaaaaggctgaatattattattgtggctgaaggagcaattgatacccaaaataaacccatcacctctgagaaaatcaaagagcttgtcgtcacgcagctgggctatgacacacgtgtgaccatcctcgggcacgtgcagagaggagggaccccttcggcattcgacaggatcttggccagccgcatgggagtggaggcagtcatcgccttgctagaggccaccccggacaccccagcttgcgtcgtgtcactgaacgggaaccacgccgtgcgcctgccgctgatggagtgcgtgcagatgactcaggatgtgcagaaggcgatggacgagaggagatttcaagatgcggttcgactccgagggaggagctttgcgggcaacctgaacacctacaagcgacttgccatcaagctgccggatgatcagatcccaaagaccaattgcaacgtagctgtcatcaacgtgggggcacccgcggctgggatgaacgcagccgtacgctcagctgtgcgcgtgggcattgccgacggccacaggatgctcgccatctatgatggctttgacggcttcgccaagggcc

SEQ ID NO: 22369 - DNA, 658 bp, Homo sapiens
attccagtaaaaggaccccagcatcaacgttcttcctgcagggctgggttctcagagaaagaaaacgtgatgcagcagaggatgggattgaagaaacaggagagtgaagtggaaatagcctggcccgcgtgacttaaaccggcccggagatgtgcgggtatgaacgctgccgtccgtgccgtggtgcgcatgggtatctacgtgggggccaaggtgtacttcatctacgagggctaccagggcatggtggacggaggctcaaacatcgcagaggccgactgggagagtgtctccagcatcctgcaagtgggcgggacgatcattggcagtgcgcggtgccaggccttccgcacgcgggaaggccgcctgaaggctgcttgcaacctgctgcagcgaggcatcaccaacctgtgtgtgatcggcggggacgggagcctcaccggggccaacctcttccggaaggagtggagtgggctgctggaggagctggccaggaacggccagatcgataaggaggccgtgcagaagtacgcctacctcaacgtggtgggcatggtgggctccatcgacaatgatttctgcggcaccgacatgaccatcggcacggactccgccctgcacaggatcatcgaggtcgtcgacgccatcatgaccacgg

SEQ ID NO: 22370 - DNA, 453 bp, Homo sapiens
acttcatttaccagctgtattcagaagagggcaaaggcgtgtttgactgcaggaagaacgtgctgggtcacatgcagcagggtggggcaccctctccatttgatagaaactttggaaccaaaatctctgccagagctatggagtggatcactgcaaaactcaaggaggcccggggcagaggaaaaaaatttaccaccgatgattccatttgtgtgctgggaataagcaaaagaaacgttatttttcaacctgtggcagagctgaagaagcaaacggattttgagacggtttccatgcagccgccgcggtgaactcccgtctggtggacactcccccagggcctcggtgtgatggagtttcctgaatcagcgcaggcagacgtgggacacccttgtgcaccttttcattttacttctgtttttaaataaaggccctaaatgctgcttaaaataa

SEQ ID NO: 22371 - DNA, 2657 bp, Homo sapiens
tgtttacagctgaagttggctgcatgcagcactccttggagctatctctaccctaacggggaaatgagacaaaaataattgaagggtatttggcttggttaagtgggcagaagtgtcctcatcaaaacaactttgaagacctgctttgtgtgtgggtgcgagtgggtgtgtggcccttaacttgttcacaagggacaacaacaacaaggaattaaccaagctttctcattgagagtgatcgtccatgcaaaccctctattttagttactcatacgacactgttgcagcttcaggttggacagacctattttggagtcccttgactgctttctggacaccctcactgagccagtcggtggaagtgaaggatgagtgattttgaagaatggatttctgggacatatagaaaaatggaagaaggtcctctccctctgttgacttttgctacagctccctaccacgatcagaaaccaggaacaagtggattacggaagaaaacctattattttgaggaaaagccatgctatctggagaatttcatccagagtatattcttttccatagacctaaaagatcgccagggatcatcactggtggttggtggagatgggcggtactttaataaatcagcaatagaaacaatagtgcagatggcagctgccaatgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttggg

SEQ ID NO: 22372 - DNA, 2472 bp, Homo sapiens
cctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaagatcgtgacagttaagacccaggcgtaccaggaccagaagccgggcacgagcgggctgcggaagcgggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagctacaa

SEQ ID NO: 22373 - DNA, 2234 bp, Homo sapiens
atttcacaggaggcctagagaccggcgctcccctttcccctcccgccggacctgccaggaggtgggctggcgcggagggagggccctgtcccctgtccctttaaggaggagggccaaacgccggcctagagtgcggcgtagcccccacccgccgtgccctcaccccagagcagctgcagcctcagccggccgcccctccgccagccaagtccgccgctctgacccccggcagcaagtcgccaccatggtgaaggtgttccagagcagcgccaactacgcggagaacttcatccagagtatcatctccaccgtggagccggcgcagcggcaggaggccacgctggtggtgggcggggacggccggttctacatgaaggaggccatccagctcatcgctcgcatcgctgccgccaacgggatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaa

SEQ ID NO: 22374 - DNA, 2345 bp, Homo sapiens
gctcggggccggccgcttccgcgcgctgccgcctcggtttccacctcccgctcctccctctccttcgcgctcgctcttctggcctggaggcccgacggaggtcgccgggctggggaaagtggccacgggacccggcagacctgctcgcctgactcccggggcgccgggaggtgcgggcgcggagcctcccaaggtcacgcccgactctccgtctctagccgctgccttccctctccccgtcccccgcccctcccgaggcgtctgacatttgccctaaccttgcagccttggaagatacgattacggcgcagagtgctgtcgccttaagcaggaaagatcggtcgcttggttatcggacagaatggaatcctctccacccctgctgtatcctgcatcattagaaaaatcaaagccattggtgggatcattctgacagccagtcacaacccagggggccccaatggagattttggaatcaaattcaatatttctaatggaggtcctgctccagaagcaataactgataaaattttccaaatcagcaagacaattgaagaatatgcagtttgccctgacctgaaagtagaccttggtgttctgggaaagcagcagtttgacttggaaaataagttcaaacccttcacagtggaaattgtggattcggtagaagcttatgctacaatgctgagaagcatctttgatttcagtgcactgaaagaactactttctgggccaaaccgactgaagatccgtattgatgctatgcatggagttgtgggaccgtatgtaaagaagatcctctgtgaagaactcggtgcccctgcgaactcggcagttaactgcgttcctctggaggactttggaggccaccaccctgaccccaacctcacctatgcagctgacctggtggagaccatgaagtcaggagagcatgattttggggctgcctttgatggagatggggatcgaaacatgattctgggcaagcatgggttctttgtgaacccttcagactctgtggctgtcattgctgccaacatcttcagcattccgtatttccagcagactggggtccgcggctttgcacggagcatgcccacgagtggtgctctggaccgggtggctagtgctacaaagattgctttgtatgagaccccaactggctggaagttttttgggaatttgatggacgcgagcaaactgtccctttgtggggaggagagcttcgggaccggttctgaccacatccgtgagaaagatggactgtgggctgtccttgcctggctctccatcctagccacccgcaagcagagtgtggaggacattctcaaagatcattggcaaaagtatggccggaatttcttcaccaggtatgattacgaggaggtggaagctgagggcgcaaacaaaatgatgaaggacttggaggccctgatgtttgatcgctcctttgtggggaagcagttctcagcaaatgacaaagtttacactgtggagaaggccgataactttgaatacagcgacccagtggatggaagcatttcaagaaatcagggcttgcgcctcattttcacagatggttctcgaatcgtcttccgactgagcggcactgggagtgccggggccaccattcggctgtacatcgatagctatgagaaggacgttgccaagattaaccaggacccccaggtcatgttggccccccttatttccattgctctgaaagtgtcccagctgcaggagaggacgggacgcactgcacccactgtcatcacctaagaagacaggcctgatgtggtacgtccctccacccccggacccatccaagtcatctgattgaagagcatgacagaaacaaaatgtattcaccaagcattttaggatttgactttttcactaaccagttgacgagcagtgcatttacaaggcactgccaaacaagatgcccttgggagctgtgagggaaagaggacctgcgggcttagatcaatctcaattccttttcatgccctcctgcattgctgctgcgtgggtatttgtctccttagccatcaggtacagtttacactacaatgtaagctataggtggagcatcagcagtgagtgaggccattcttcatccttaggatgtggcaatgaaatgatggtgcaagttcctttctcttttgtgaatctttccccccatttcctgtttacatgtaacccaacaaaatgcaatttctagtgccttctgtccaatcagttctttcctctgagtgagacgtacttggctacagatttctgccttgttttgcgacattgtcccattcacacagatattttgggataataaaggaaaataagct

SEQ ID NO: 22375 - DNA, 3264 bp, Homo sapiens
ggctctccccgcccccgcctccgcctccacgtcttggggccgggccggaaggcagatctcaccgcctgcttccctctgcagcggtagcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtgcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgtaggatagccactttttaggtatatgtacatttatatttctatcaattccttagaaagtaaaataaatgaatagatcaaatgttgtgttcatgtttggggaaaatataatttgcagaaacctatgaagtagagcaaagatgctttaaaaagataagtttttttgaactaaattttttttagttctaataatgcacataggatattagtacatcgtacacgtgctaggaaaaaacagcttcagtgtctttgtttaatgtgttgaaactcatctttttaaatcttgaaaaaccaattgtttacttgaaacttgaaagtagcatatttttctgttttttggttgtttgttcatttgtattagcacaatttaatgtaattcctggtttggaggcagcaagacctatgagcaagaactatttacttgaccctcgtttttttctcttgttcttgtgtggtctgaaatctaaaactagactttattatgatagatttcctataagccaatttctaataacaaatagatttattatttaatctgtaccttctatcttctcataattcgtggtcttacagccttccaaaataactccagttgggcacccatgagctaggatcaaactttctttatatactttatatattttacattatttctgatttttaaagcaaatgattgccattatgattacactcaacctaaatagttatgaacagtttcagaacaatgaaaaattacaatactatgtgatagtattgtaactatttttctattttagtcatatgtcgcttatatcctaccagaactcttaaatctataatattcgatatattctacaaactgctttattgtagaagccatatttatgtttattttataatgttttctagtgtcaaactgtactgtggagaaaagaaatgttagatctgt

SEQ ID NO: 22376 - DNA, 2050 bp, Homo sapiens
acaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggatacatgtgctgcccttttgttctggacaaagatggagtcagtgccgctgtcataagtgcagagttggctagcttcctagcaaccaagaatttgtctttgtctcagcaactaaaggccatttatgtggagtatggctaccatattactaaagcttcctattttatctgccatgatcaagaaaccattaagaaattatttgaaaacctcagaaactacgatggaaaaaataattatccaaaagcttgtggcaaatttgaaatttctgccattagggaccttacaactggctatgatgatagccaacctgataaaaaagctgttcttcccactagtaaaagcagccaaatgatcaccttcacctttgctaatggaggcgtggccaccatgcgcaccagtgggacagagcccaaaatcaagtactatgcagagctgtgtgccccacctgggaacagtgatcctgagcagctgaagaaggaactgaatgaactggtcagtgctattgaagaacattttttccagccacagaagtacaatctgcagccaaaagcagactaaaatagtccagccttgggtatacttgcatttacctacaattaagctgggtttaacttgttaagcaatatttttaagggccaaatgattcaaaacatcacaggtatttatgtgttttacaaagacctacattcctcattgtttcatgtttgacctttaaggtgaaaaaagaaaatggccaaacccaacaaactaacattcctactaaaaagttgagcttggacatattttgaatttttgtaagtgaagatttttaaactgactaacttaaaaaaatagattgtaattgatgtgccttaatttgcataaatcataaatgtatgtcctctctgtaattgttttaatgtgtgcttgaaatatccagaaaacctatggagttagtaaattctgggctgtcatatgta

SEQ ID NO: 22377 - DNA, 1646 bp, Homo sapiens
gcacaagctcagcgatggcggctccagaaggcagcggtctaggcgaggacgcccggctggaccaggagaccgcccagtggctgcgctgggacaagaattccttaactttggaggcagtgaaacgactaatagcagaaggtaataaagaagaactacgaaaatgttttggggcccgaatggagtttgggacagctggcctccgagctgctatgggacctggaatttctcgtatgaatgacttgaccatcatccagactacacagggattttgcagatacctggaaaaacaattcagtgacttaaagcagaaaggcatcgtgatcagttttgacgcccgagctcatccatccagtgggggtagcagcagaaggtttgcccgacttgctgcaaccacatttatcagtcaggggattcctgtgtacctcttttctgatataacgccaaccccctttgtggtagaagcattgaaagcattggaatggaggcttagaccatcgttgtgtttgaagaattttctagctctaccaagtagaagatggaatgagaaggcactgaggaaattactcacctttcttattaggaaatacatcctggaattatgagcagccagttaattctaaggcccttcacagtatcacatttgaaactttgtgctggaatcatgataactgcatctcacaatccaaagcaggataatggttataaggtctattgggataatggagctcagatcatttctcctcacgataaagggatttctcaagctattgaagaaaatctagaaccgtggcctcaagcttgggacgattctttaattgatagcagtccacttctccacaatccgagtgcttccatcaataatgactactttgaagaccttaaaaagtactgtttccacaggagcgtgaacagggagacaaaggtgaagtttgtgcacacctctgtccatggggtgggtcatagctttgtgcagtcagctttcaaggcttttgaccttgttcctcctgaggctgttcctgaacagaaagatccggatcctgagtttccaacagtgaaatacccgaatcccgaagaggggaaaggtgtcttgactttgtcttttgctttggctgacaaaaccaaggccagaattgttttagctaacgacccggatgctgatagacttgctgtggcagaaaagcaagacagtggtgaatggagggtgttttcaggcaatgagttgggggccctcctgggctggtggctttttacatcttggaaagagaagaaccaggatcgcagtgctctcaaagacacgtacatgttgtccagcaccgtctcctccaaaatcttgcgggccattgccttaaaggaaggttttcattttgaggaaacattaactggctttaagtggatgggaaacagagccaaacagctaatagaccaggggaaaactgttttatttgcatttgaagaagctattggtaagaagtgatcatgaacattaaggaattggctgcaaggcaaaaggaaaaggtttggattgggattcaaagatccacagtgaaacacggtttattttgcctctccagcactcaggttgaatgtcgaactgtcctactccaaaattgacatctcagatgatttacagccaaaaggaatgtctt

SEQ ID NO: 22378 - DNA, 8515 bp, Homo sapiens
gggcgggcggcggcggcggcggcggagccaggacccagacatctgggactgttgttctctcgcggcgcgaccgcctcagtcacttcgcccagagacccggacctggtccgctggggagcaggcggccataaaccccctctctcccggttccctgacgccgcggcaggagctgttacgaacaccctgcggttggtctccgatgcccttcagtgaggtggggacgcctggaccctggtgagcgaaccccaagccaccccccaccccaactcagtgtcttcgccggcccccggcccgtacgcctgtctggtcgccatggctgaaaacacagagggggatctgaactccaacctgctccacgccccctaccacaccggggaccctcagctggacacggccatcgggcagtggctccgctgggataagaatcccaaaacaaaagagcagattgaaaacctgttacggaatgggatgaacaaggagctgcgagatcgtctttgttgccgaatgacttttgggactgcaggacttcgttctgccatgggggcagggttttgctatattaatgaccttacagtaatacagtcaacacaggggatgtacaaataccttgagagatgtttctcagacttcaagcagagaggctttgtggttgggtatgacactcggggtcaagtaactagcagctgcagcagccagaggcttgctaaactcactgctgcagtcttgctggccaaagatgttcctgtgtaccttttttcaagatatgttcctacaccttttgtaccatatgcagttcagaagctcaaagcagttgcaggtgtgatgattactgcctctcacaaccgcaaggaagacaatggatacaaggtttactgggaaactggtgctcagatcacatctcctcatgataaagaaattctaaaatgtatagaagaatgtgtggaaccctggaatggttcctggaatgataatttagtggataccagcccgctgaagagagaccctctgcaggacatttgcaggagatacatggaagatctgaaaaagatctgtttttacagggagttaaactcgaagaccaccttgaaatttgtgcacacatcttttcatggggtcggacatgactatgtgcagttggcttttaaagtgtttggttttaagcctccaattccagtaccagaacaaaaagatcctgatccagacttttctaccgttaaatgtccaaatcctgaagaaggagaatctgtgctggaactttccttgagactggcagagaaagaaaatgcccgggtagtgctagccacagatcctgatgcagacagactggcagcagcagaacttcaggagaatggttgttggaaagttttcacagggaatgagttggcagctttgtttggatggtggatgtttgattgctggaagaaaaataaatcaagaaatgctgatgtgaagaacgtttatatgttagccaccacagtctcttctaaaattctgaaggcaattgcacttaaagaaggatttcattttgaagaaacattaccaggttttaaatggattggaagtaggataatagacctcctggaaaatgggaaagaagtcctttttgcatttgaagagtctattggttttctctgtggaacttcagttttggataaagatggggtgagtgcagctgttgtggttgctgagatggcatcttacctggaaaccatgaatataacattgaaacagcaactggttaaggtttatgaaaaatatggttatcatatttcaaaaacttcctatttcttgtgttatgaaccacctaccatcaaaagtatatttgaaaggcttcgtaattttgattctccaaaagaatatccaaaattttgtggaacatttgctatattgcatgtacgggacgttaccactggatatgacagtagccagcctaataagaaatcagtgctgcctgtgagtaaaaacagccaaatgattacatttacttttcaaaatggctgtgttgctacccttcggacaagtggaacagaaccaaagataaagtattatgcagagatgtgtgcgtcacctgaccagagtgacactgctttactggaggaagaactgaagaaactcattgatgctctgatagagaattttcttcagcctagtaagaatggactgatctggcgttctgtttaggggtacaccaatatgtcatgacactgtgtgggcatatggaacagagcaaccgagaactgcatacattgaaccttgtgttagcattctctctctatctcatctggccgagtatctttttccttttattttctttctttttggtcaactggctagactaaacaaagtataagtttgaaatgaaatggtctagagggaaatgattcaaattttttcataattcaaacaaaagttattacactaaaagtattatagtaacgtattgtccttccgttaacagaaacatcacaattcaaaagtgagttttcttattatagtgtgattaagcctagttctgtatctcgtaattgtgtatagcatggtaaaagaaaaaaaaaaagacaggtaaatgttatataattgtagggttagttaaggaaattagtccataaaattggcaagaaaatggtactttccttgattgttatgaaaaagtgtcattgtgacatcacaggtattaatttacaaattagagtatttgaaataggatatttagcatttctgtagtttagaacagatgttacagtgtgtggttttggcatgtctgtttcaggtgcccttggtgcagtataaatttactgtatgtatttaaaattctgatgtttactgaacataaaacaatagtggcaacactcctattggctttgttcttatcaaatttctcagtgccttctcagggtctggtgtgaacagaaaaaacagtgttcctgcatttaccataatttaatcagtcaatttgcagatagctaaggaaaatcttccaaaatctgtaggtgcttcctctatatcaagtgagtttgctgattttaaaatcttaggaatataaataaagatcttaataaaagcaagcttaatgtagttaaggatcttcatattagaattgtgtcatttatcaaaccttttattacagaaaaaaatctgaactgagaaaggagctctgaatttatttgacagtctaacttttgaattacatttttgtaagtagatttattcttttattttatgaagtaatgttaattttactaagaataaaacatccaaattttaagtattatgaaatactaaaactacatgttttaaaacagaggtccagtttattctaacatcttgctgacttctgtagaatttctgattgcatgactattatttatcttcttttagtgtagaaaataattttttacaaaaagtcacttttgggctgggcgcagtggctcacgcctgtaatcccagcactttgggaggctgaggcaggtggatcacaatgtcaggagtttgagactagcctggccaatatggtgaaaccctgtctctactaaaaatacaaaaattagccgggtgtggtggtgggcacctgtagtcccagctactcgggaggctgaggcaggagaattgcttgaacctaggaggctgagattgcagtgagccgaaatcacgccactacactccagcctgggcaacagagggagactccatctcaaaaaaaaaaaaagtcacttttggctaatcatgcagtcttctgaaaaggtttaatagagaaatgctgtttaggctgggcttggtggctcacatctgtaataccagcgctttgggaggctgaggcaggaggattgcttgaggccaggagtttaagttacagaactatgatcacactgccgcactgaagcctggatgacagagtgagaccttatctcaaaaaaaaaaaaaaaaagagagagagagagaaaaagaaatgctgtgtttaatcttcttaaaatgtatcttgtcctacatagttctcagaatacatatggggtatagttaggagataacaataacaagacctaaacaaattgcttatgggagatagcactgtaattagagaatttatttcatataaaataataatataaagtttgaactgattagaatgttccttaaatcatggtttcgtttgttgcagctgtcagctaacatttggttgagctcatataatccaaacctaattgtccaactattgtattgccactattgttaatttgttccttccttactttcttattgttggatcttatatgactgtatgactgtagataatagacagctagctaaatgtagagcaccatttttctcaatgagtttgttttcaaaggctttgcactggagaagatatgtgtagaatttttgttttatttttaaaatgtgtaaaacatcttttgttttatatgcttttaagaatgtagattgtaatttaggaaatggcatatattctgcaaagtggtataatgttgtatatatgaaaaacaggtatatttggtttagttctgtgtttcagtgactgataaacaaaaatgaagctaaaatgaatcaacggctcattcatagttactaaagccatgtcatgactgtcattctattatgaagaaaacagttttatttgagtgctttaatataatgcaacatttaagtcatcttaaggtgaaaagttattgaagtgttcttctctcaagttaacaaaattttacaaatgttcctgaagtgtatcgattgagggaattattttattctagcctgtcatgagtctgtctgagcatgatacttaacatgaacttgatgtagtaggtgcacatttgcctaacaggataaattcagtgatagcccaagctggtcaggagagacagaagtgctggctaggaggtctcagcctcgggcactacaatgtttatctttttctttttgaacaatattgtgaaaatgattgcattctcattgagcatgaaagtcaaaactggaattttctaaagctttggagaaaaggagagaattagtagggcaagatcaaagcatacattggaaataaacagtagaaataagcaaacaatataaagagacacgggaaatgcttctcgtgaagggcaaatgtaacaccataacagtagggaataaactgtgtcccacctgtttacttgtgtttatttgttgttatgatgagtatgcacctaccattttcctttattgtgatcactaaaatgaggccaaggtttaggaggtgagaaaaagtatcccttttacggattcagttcctgctaggatgttgtatcagaatcatgtgagaactcaggaagaggtagagcagaaataaaaaggaagaaaatgtagattagaaaataagacttctgagaaaaagttcaaggaataaagattgtttgactctggagaggagaaagctgttgagatagtttgctaagtttgctaataaagctttattgagtcttttattgaagggttcaaagtaagaaatactatgccatagtgttctccatctctagtgaagacagaaccagagggaataaggatcttttttttaaagacagcatggaaagtttaagatttaggaacttcttgagaaatcttcataatatcttctattcaaaatcttttttttatttttaagggaataaaaattttaaaaattaagagatatacagatgactttttaagggtccttctttccagcacattttttttaaaaactcaggttagaacaaaaatgtcataaagggcactaaaagtaacatttgggtttcactccatatctagaagaatttagctcacaaaacaatttttgtgtgttttgagtaactgatgcataagtgcaatgaataattttcctgcttcactgttatttttaatttaacctggcaaattaagtgagacttgaacaaaattttgttcatcttgaagaatgtatagtggcttaggttatttgaggttttcgttttgaatatatatgttgttattttgatgtagatacgttagcagatggagaggttctaagagattggatactttggaatgtctttatataggaaatagacctcccatttcttaagcaagttgcttctggaattgatgcaacagggatattagctgtagtttaatggataagttgttctatgagctgctgctatcagtacttttttccacattttccattgatatttgtgatgcttgaaaaatccaaacttcacttggatacatttaattttatgcctttttctctctacctcccacttttcctaggcacccttgcacattttgttactgtgaaggactattgccctgttacctcactgataagaaatctcaactgtattcattcagaatgctttaagcttagtcataaactacatttgcctatggacctttggttattttgttaatgttgtcattatatttaagacttattgtaggaagtaattttaaatctatttcataacctgttttgatctgtctgcatactgctatatgttaatttattacggccttttacaattcacttgtcatctgagattgttctagaaactgatgaggaaagagtcgtactaaccaaaatgaatgggcaattgacataacattctatttcaggtttccttgtacttggggagccaaagcacaagatctaaggaaatcttattcacatttgtccctcagagcatcttaccctaagccatagaggtataaatagtaagatgagaattgctcattgtctgactccttgcacagcatgaatttaattctagttggaaacaaagttagtgttgactactggttaccttaaagtattcaccatactatatatttattagaccatctttcctctttgtttattcaagactatgtacttataaaagagaacctataagaatgtgtagagtgaccaaatagggacaaagtgacatacctagagtttgctgctcaaatttttccactagcgtaaccctaaagcagaggggcatgatgaagggggaaggggttctgagagcaaaatcagaatcagcctaccactgacatgaagtgtgttctgtctttaaaatgtaagtgaattttgcattctttataataaaacttttaatataaaaatgatatgtttaatctttactgaaacttatgccaccacaaaggagcaccatgttcatcacgtggctgctcagttttctcccccagtgccctcacccccagtggaggcaagtccttgagctacacacactggctgtagtgcaagatatataaacataggccgggctcggtggctcatgcctgtaatcctagcactttgggaggccgaagcaggtggatcatctgaggtcgggagattgagactagcctgaccgacatggagaaaccctgtgtccactaaaaatacaaaattagccgggtgtggtggcacatgcctgtaatcccagctactcgggaggctgaggcaggagaatcacttgaacccaggaggtggaggttgtggtgagccaagatcgcgccgttgcactccagcctgggcaacaagagtgaaactccatctcaaaaaaaaaaaaaaaagatatataaacatagaacatatccagactatttcctgcccttggaatctgaccttcagaaggattaatgccaaactaaactgacctgaaacagttttgttactattggcattccttgactaaaaaggaccacctgatgctcagtcccgagagtaggaatcgtggtttattatttttcatatccataccacctagttcagtacctgttatagagtgtttaattgctgatactaggaattaagggattttttaaaagtagcaaatagtttaaggaacaatcaaaaaatgaattttctaattcagttttttcaatgaagtcccatcactgaactttataatgtaatgtttattaagcagacatccccttaaatactcagtttctttggagagagcaaagcatatctctctgtggaaattatatataatgcctggtattttacactcaaagcaaggtgttggccaggaaggtaaagaaatggtgtctatgtagacttaatatcactagtctaagtgtcattttgagcctagtagcactaccttccaagtgagtcacaacaaatttgatcctatttggtatgtttttgtccactgttatgattcatcatgtatcttacaagagccactcaagcaagactctgcttctatgtatggtgaggccttgttgttctaggctagaataaactctttgtatgcctcattgaatatgccaggtaaaatttatgcagtcaagaatgaattatttttctgactaaagtgtgtagcagtagttcaaaattgtgcccttgttttaacagtttctgtcaacatcttctcatttttccctacaaaaacaccagggtgtattataagtactgcctgtgagaatttgcactttatgtatttgtgtgtggatttcttgtggttttagccaaatgaagtgttatcagtaataaacaggtctcttcata

SEQ ID NO: 22379 - DNA, 1971 bp, Homo sapiens
aacaccgcggtggccttttcgcttgggccgcattccagggctccggacgtttacgattcactggcctctgccccgagggacccaggataaggttgagagtggaccaatttaagtgtgcccggcgtccaggatagtcctggagctaaaatgggaggagagtggggacaatctgctatctgccctgagtctgcccaggagtggacataccaagttggacaacatcttgtagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcct

SEQ ID NO: 22380 - DNA, 556 bp, Homo sapiens
gactcgcggaccgcccccccccaacaccgcggtggccttttcgcttgggccgcattccagggctccggacgtttacgattcactggcctctgccccgagggacccaggataaggacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttct

SEQ ID NO: 22381 - DNA, 6107 bp, Homo sapiens
gagccggaagccacgcagggccacgtctgcggttctgaggactgggtttgggtgcagacgttgttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggtttctgaagataattttcatattcctgagaaactggactttttacaagtctttacaaaactgtcaataataatggcagtactaagagatttataatcataatgtttacaatgcagcctactggattgtctctagatctgtttttcttaaacactaacagaataattctttataaataggtaagccttacacttgttaaagaaatttacctctaatttcagtctcactaatgtaaaatactgggacttaagtatacaattcagtcactaactgtacagttttatgtggggaacaattcatgcaggctactggaaaattaaatcttattaccaactccttgtgatatctttgccatcaccatcacatgagcaagatgatgttttgcagcattccccattgctgatacaaatggagagggcagagaagactttatacaaccagtttttccattgcagagtcttaagaaagattattagatgacttacctatatgactaatgccatcaggaactcagaggtatgaatagggggttgtccatccctcttccatactgaggtggagatgctcatgcaatacttttaaggatgcatggtccagccttcagttattcttcactgctcttggtgaaggtatgtgggagaaaaactaattataatacgtttcccagcctctgatggagaaggaacaccattctgataccagaacatggttaataaggaaaagagaaaaatccccaaccaatcttaattgaaccaagtctgaaaccaatggaaaaaaaaaatgggtagtgtatattttgcaggtttaagacaactcaggacaataaaaacaatggactttacatgtgtatatatatagctctcttaggcaccataatcagtatgagccaacaatatttaaacttgattcaggccacattcagacatttgctcttatatacaaatatttaaattaaatacaatctgaaatgtgttctgttacatacaaaaaaggaaaaactatacaacgcagagcagtgtgtgtgttttaaataattacatttacatgtaagctaaatggaaccagcaatggtgctcaagtttttatcatcccttccagaaaatctttttctaccatctcttctattttttgcctggctttgctggaacatggtttgtggttctccagtttcatgtccttattagggaaggcatttgagtagaggataggactccctgagtgtcctccacatcggcttgtgactttgctgttgaagacttgactgagcacattgaagaacggcaggagctgctccatactgcgcacggtgcagatggtgagcagcaagtgccctggctcccaacccaatgttctccctgagttgtcttcctctggatttttctgcagaaaacaaaaagtgaactggtattaatacaacagacaatgtggtatgttagaaaaattaaaaatatataaactttggcaattggtcaagaaatgaatacaaatgacattaagtttctaactcctgacctgatcaaaacccttggtgcttctgagaccttttactgccatttattagttttacatggagcagtctaacattgtagtaatagttcccaactagaatgcgcagataagcttagttaacagaaatagctttgaacaggaatagagtcaaacataaaagttttatgttgtgctttgtatttactcaaaaagctcccaggtttctgaaccctcactactgtaaccaaggactaggtcacaaaattactacagaaaaaaggaacaaagtgctttatacatttcataatatatccccttttattataattagttaattcccttttatctaaatggcctaaatttgccatgatggtagcagtgtccaaagtgaataattactgtcagtactgcatcacagagaaaggaagggatccctcaggagacactgctgtctccttctgggttgtgctaaacaacatagggaggaaagctggacctggagtcaaaggaattgagttagtgtgctggctctgccatacttacggcacccttgggcaggatatacaaaggttcctcacttataaaatgggacagtctaaaactaccttttagtagagaagtcaaatgagaaggtatgtgaaaactctgtcaactaaatataaagactaataatttgggtattaagaggctagtttgagaagccacctgaattacacaaacacagctacagacatcattctgtctagagaaagataagagagaacaggttggttgaacttgggcagaatcacagatacaattccacactaaagaatgaaaataagcaatgaactagacagaaggaagaaatcatgaagacttaggaagcagaattacaatctgtcatattaacaaatggagtttgccttctaagatcagatgttgctcagaaactttcattgtttacctaataatttaatatcactagtttcctagtgggtcaagcagatgcaaaatccagcttattttcttctatgtgctctcaagcttattgcttattttaaagtaaaatcctgaaaaaggaaaatattaggttggtgcaaacgtaattgcggtttttgcattgttgaaatttgccgttttatattggagtacattcttaaataaatgtggttatgttatacatcattttaagcatatttctcactttttttttgctaatgacttattgctgtttatatttattttagactatggaaatgatgttagacaaaaatcaaatttagcgattttctgagttcaaaataggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaagtgtcattttctctattctatgcaacaataatgaatcatttctctatcggattgtgatgtgtgccaaaaggtggattttatacgacaactggcgatgaccagctcagtggctggactgaaagaagctccaaagcacttcccaaagccaaacttgctccaaaaaatggtcatggtcattgtttggtggtttgctgccagtctgatccactacagctttctgaatccaggtgaaaccattacatctgataagtatgctcagcaaatcaatgagatgcaccaaaaactgcaatgcctgcagccggcattggccaccagaaagggcccaattcttttcacgacaacactgggccgcacgttgcacaaccaacgcttcgaaaattgaactaattgggctatgaagttttgcctcatctgccatattcacctgacctcttgccaacaaactaccacttctttaggcatctcagcaacgttttgcagggaaattgcttccacaactagcaggacacagaaaatgctttccaagagttcgtcaaatttggaagcatggatttttatgctacaggagtaaacaaacttatttctcattggcaaaaatgtgttgattgtaatggttcctattttaattaataaagatttgtgtgaacctagttataatgacttaaaattcatggtcccaaacagcaattacttttgcaccaaactaaaaatataagttaaaatggaagagtctaggagcaaaccaagaaaagatcacctacttcatcatctctggtcaaaaacaaaccaaaaaacttaacagctatcacttaagtttgcttcctagcaattatttagcttccagtctagattacaggatatataaaactttctttctttctttcttaactatgacactggcaccaatgagagtcctgtgactgactttcacatttccaccattactcaattactggtaccataccacctctaatcccctaaatcaaactgcaattcaacaataaagggcgtacagagatgactttgtcctgaaggaaaatgaatatccttgtaccctctatatagctaacttccaaatgtaagagaactatggggtaaccttttgtttctattcctatcaagatgagcctttaagagagggacttttattaagctcttgaccaagaagaatacacttgattcagagtttctgatgctcttaatcagaactatatgtattgtctcaatattaaataaagtcaaatgtttccatacaaa

SEQ ID NO: 22382 - DNA, 2013 bp, Homo sapiens
gttgcttgggcgcttctccgctgcgtgtaggtgaagggggcttcctgaccgagacatggatttaggtgctattacaaaatactcagcattacacgccaagcccaatggactgatccttcaatacgggactgctggatttcgaacgaaggcagaacatcttgatcatgtcatgtttcgcatgggattattagctgtcctgaggtcaaaacagacaaaatccactataggagtcatggtaacagcgtcccacaatcctgaggaagacaatggtgtaaaattggttgatcctttgggtgaaatgttggcaccatcctgggaggaacatgccacctgtttagcaaatgctgaggaacaagatatgcagagagtgcttattgacatcagcgagaaagaagctgtgaatctgcaacaagatgcctttgtagttattggtagagataccaggcccagcagtgagaaactttcacaatctgtaatagatggtgtgactgttctaggaggtcaattccatgattatggcttgttaacaacaccccagctgcactacatggtgtattgtcgaaacacgggtggccgatatggaaaggcaactatagaaggttactaccagaaactctctaaggcttttgtggaactcaccaaacaggcttcttgcagtggagatgaatacagatcacttaaggttgactgtgcaaatggcataggggccctgaagctaagggaaatggaacactacttctcacagggcctgtcagttcagctgtttaatgatgggtccaagggcaaactcaatcatttatgtggagctgactttgtgaaaagtcatcagaaacctccacagggaatggaaattaagtccaatgaaagatgctgttcttttgatggagatgcagacagaattgtttattactaccatgatgcagatggccactttcatctcatagatggagacaagatagcaacgttaattagcagtttccttaaagagctcctggtggagattggagaaagtttgaatattggtgttgtacaaactgcatatgcaaatggaagttcaacacggtatcttgaagaagttatgaaggtacctgtctattgcactaagactggtgtaaaacatttgcaccacaaggctcaagagtttgacattggagtttattttgaagcaaatgggcatggcactgcactgtttagtacagctgttgaaatgaagataaaacaatcagcagaacaactggaagataagaaaagaaaagctgctaagatgcttgaaaacattattgacttgtttaaccaggcagctggtgatgctatttctgacatgctggtgattgaagcaatcttggctctgaagggcttgactgtacaacagtgggatgctctctatacagatcttccaaacagacaacttaaagttcaggttgcagacaggagagttattagcactaccgatgctgaaagacaagcagttacacccccaggattacaggaggcaatcaatgacctggtgaagaagtacaagctttctcgagcttttgtccggccctctggtacagaagatgtcgtccgagtatatgcagaagcagactcacaagaaagtgcagatcaccttgcacatgaagtgagcttggcagtatttcagctggctggaggaattggagaaaggccccaaccaggttataaagcagcagagacaacacacaacatcaacaatgcatttggcccaggaactgctaatgaacatacagtgccgtgatggctcaagaagttttgcaaaggagactagagccttgaagatgaggagtgcagtggccagtcatcggaaattgataatgaccaattgagaacatcatcgaagctgatcctcttacaactataagagagctgcccaagaactcaatgttgaccattttatggtcgttcggcatttgaagcaaattgaaaaggtgaaaaagctcaataaatgggtgcctcatgagctgagtgaaaaataaaaaaattcgttgttttgaa

SEQ ID NO: 22383 - DNA, 3191 bp, Homo sapiens
ggaaggcagaagcaatctctgccgagagagtcagccgagcggccgcgcggagaggaggggcgggcggtccccaggcgggcgggtgcagggcgcagggcgccgacctgctggagagggggcccgggcgcgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggccggccggcggcgggggtctgcggcgacccaccggcctcttcgagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacgggattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggagtggagatagtggacccagtggatatctatcttaacctccttcggaccatctttgactttcatgccatcaagggtttgctgactggacccagccaactgaagattcgcattgacgcaatgcacggagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacagagtggccaaatcaatgaaggtccctgtatatgagaccccagctggatggagattcttctcaaatctgatggactcaggacgttgcaatctgtgtggggaagagagctttggcactggctctgaccacctccgagagaaggatggcctgtgggctgtcttggtctggctctccattattgctgcccggaagcagagtgtggaggaaattgtccgagatcactgggccaaatttggccgccactactattgcaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacagggcctaaggatcattttctcggatgcatcacggctcatcttccggctcagttcctccagtggtgtgcgggccaccctcagactgtacgcagagagctacgagagggatcccagcggccatgaccaggagccacaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggacatttagtggccaataaaaaagaaattcctaatttcaacctta

SEQ ID NO: 22384 - DNA, 3338 bp, Homo sapiens
ggaaggcagaagcaatctctgccgagagagtcagccgagcggccgcgcggagaggaggggcgggcggtccccaggcgggcgggtgcagggcgcagggcgccgacctgctggagagggggcccgggcgcgaggcggagtcccggcgcgcagccaggctggtggaggcccccggcaggctgcagattccctccggctccgggagccgcagcaggaccggccaggaggcgccatggaggggagccccatcccggtgctgacagtgcccaccgcgccctacgaggaccagcggccggccggcggcgggggtctgcggcgacccaccggcctcttcgagggccagcgcaactacctgcccaactttatccagagcgtgctgtcgtccatcgacctgcgcgaccgtcagggctgcaccatggtggtgggcagcgacggcaggtactttagcaggacggccatcgagatcgtggtgcagatggccgcggccaacgggattggacgactgattattggacagaatggcatcttgtcgacacctgcggtctcctgcattatcaggaagatcaaggcagctggtggaatcattctaacagccagccactgccctggaggaccagggggagagtttggagtgaagtttaatgttgccaatggaggtcctgcacccgatgttgtctcagacaaaatctaccaaatcagcaaaacgattgaggaatatgctatatgtcctgatctccgaatcgacctatctcgactaggaagacaagaatttgacctagaaaacaaattcaaaccattcagagtggagatagtggacccagtggatatctatcttaacctccttcggaccatctttgactttcatgccatcaagggtttgctgactggacccagccaactgaagattcgcattgacgcaatgcacggagttatgggaccttatgtgagaaaagttctgtgtgatgagctgggggccccagccaattctgcaataaactgtgttcccctggaagactttggagggcagcaccctgacccaaacctgacatatgcaacgactcttctggaagcaatgaaaggaggagaatatggatttggagctgcatttgatgctgatggggaccgttatatgatcctaggccaaaatggcttctttgtgagcccttctgactccctggccatcattgctgccaacctctcttgcattccatatttccgtcagatgggggtccgcgggtttgggaggagtatgccaaccagcatggccctggacagagtggccaaatcaatgaaggtccctgtatatgagaccccagctggatggagattcttctcaaatctgatggactcaggacgttgcaatctgtgtggggaagagagctttggcactggctctgaccacctccgagagaaggatggcctgtgggctgtcttggtctggctctccattattgctgcccggaagcagagtgtggaggaaattgtccgagatcactgggccaaatttggccgccactactattgcaggtttgactatgaggggttggatcccaagacgacatattatatcatgagggacctggaggccctggtcacagacaaatccttcattggccagcagtttgctgtggggagccatgtctacagcgtggcgaagacggatagttttgaatacgtggaccctgtggatggcactgtgaccaagaaacagggcctaaggatcattttctcggatgcatcacggctcatcttccggctcagttcctccagtggtgtgcgggccaccctcagactgtacgcagagagctacgagagggatcccagcggccatgaccaggagccacaggcagtgctgagccctctcatagccatcgcactgaaaatatcccagattcatgagagaactggccggaggggacccactgtcatcacctgaatagaggaaagatcactcaccagggccaaagagagtgctcagcgggagatgcttcactgatgccttcttgctacctgtttgtgcctcttatgactttggaaaaacaaaagatattttgcttttgggggatagagggtgggtgggaaaagaaaaaaaatccatttggttttggttttgtcctattcctccaaatgcagcagggcctttagttgtctgttaaagctgcactataatttggtatctacattttatcacacaaaggaacctccccttttgacaacaactgggctaggcagctgttaatcacaacatttgtgcatcacttgtgccaagtgagaaaatgttctaaaatcacaagagagaacagtgccagaatgaaactgaccctaagtcccaggtgcccctgggcaggcagaaggagacactcccagcatggaggagggtttatcttttcatcctaggtcaggtctacaatgggggaaggttttattatagaactcccaacagcccacctcactcctgccacccacccgatggccctgcctcccccatcccatccccaacatccctgtaccaccttctctcacatcttctaaagctttgtacaaatcacaatggtgcacttccaacaaaatatatcaataggtgttttcctctcttattttgtaaatagtattattttagctattaagctggataccttctttcaaattcagccattcagttgtaaagttgggaagaagtttcttgacaagactctgcaattaaatgcttaaaatttggaggggatccttccttgattacatcaagtatgttggtacatgggtttatacaagttcctcttgagaaggcaaaaagaccaccatgtgtgagagctctttgacttggccaataggggcctatcttaatgcacttgtttggacacatttctgatcttatttgtaaaggctgcaaaaggagaggatgaaatgctgtaaaagtaggaaatgaagtggaagctggaagaaaatgtaattggtggtacagctatgggccagatggtggaggggagggtggggacccctgccggcaagcagagtgtcacagctggctttcctcacttgggaaaagggtactgccggtctagcagcctcctctgtactcagccaggacacccagcgcgtgggacctgtttgtgtctgttttgcttccttgggaacggcacagtcactcaccctgccatttgcggaaatgacctggtgcactttgactgttaagcaatgcgttattgctgtagtcaaggttagtgcaagcaaggaaacattcccagtaaggtatttgtttccattttctgtctgtgcttctgtcagaaacttgctaggacatttagtggccaataaaaaagaaattcctaatttcaacctta

SEQ ID NO: 22385 - DNA, 1885 bp, Homo sapiens
gcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactga

SEQ ID NO: 22386 - DNA, 1959 bp, Homo sapiens
atggcccagtgagtgactcgccaggggcagcccggctcggcctcagcgggcggggaactctttgggggtcgagatctccctcgttctctccgacgcctcccaccctgggggtcgcctgagctcacttggggctctgtgaccctggccctacggcgtctcgggcccagagctccttccctgcgggcccggccccctgccctctcggccgcgcagagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacagg

SEQ ID NO: 22387 - DNA, 1474 bp, Homo sapiens
actcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaaagggaaccaaagtggtgggtgcccagtccctgaaagagatggtctccaagctgaagaagccccggcggatcatcctcctggtgaaggctgggcaagctgtggatgatttcatcgagaaattgagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagacca

SEQ ID NO: 22388 - DNA, 1833 bp, Homo sapiens
actcgtcctccgcgcgtcgccgctcttcggttctgctctgtccgccgccatggcccaagctgacatcgcgctgatcggattggccgtcatgggccagaacttaattctgaacatgaatgaccacggctttgtggtctgtgcttttaataggactgtctccaaagttgatgatttcttggccaatgaggcaagctgtggatgatttcatcgagaaattggtaccattgttggatactggtgacatcatcattgacggaggaaattctgaatatagggacaccacaagacggtgccgagacctcaaggccaagggaattttatttgtggggagcggagtcagtggtggagaggaaggggcccggtatggcccatcgctcatgccaggagggaacaaagaagcgtggccccacatcaagaccatcttccaaggcattgctgcaaaagtgggaactggagaaccctgctgtgactgggtgggagatgagggagcaggccacttcgtgaagatggtgcacaacgggatagagtatggggacatgcagctgatctgtgaggcataccacctgatgaaagacgtgctgggcatggcgcaggacgagatggcccaggcctttgaggattggaataagacagagctagactcattcctgattgaaatcacagccaatattctcaagttccaagacaccgatggcaaacacctgctgccaaagatcagggacagcgcggggcagaagggcacagggaagtggaccgccatctccgccctggaatacggcgtacccgtcaccctcattggagaagctgtctttgctcggtgcttatcatctctgaaggatgagagaattcaagctagcaaaaagctgaagggtccccagaagttccagtttgatggtgataagaaatcattcctggaggacattcggaaggcactctacgcttccaagatcatctcttacgctcaaggctttatgctgctaaggcaggcagccaccgagtttggctggactctcaattatggtggcatcgccctgatgtggagagggggctgcatcattagaagtgtattcctaggaaagataaaggatgcatttgatcgaaacccggaacttcagaacctcctactggacgacttctttaagtcagctgttgaaaactgccaggactcctggcggcgggcagtcagcactggggtccaggctggcattcccatgccctgttttaccactgccctctccttctatgacgggtacagacatgagatgcttccagccagcctcatccaggctcagcgggattacttcggggctcacacctatgaactcttggccaaaccagggcagtttatccacaccaactggacaggccatggtggcaccgtgtcatcctcgtcatacaatgcctgatcatgctgctcctgtcaccctccacgattccacagaccaggacattccatgtgcctcatggcactgccacctggccctttgccctattttctgttcagttttttaaaagtgttgtaagagactcctgaggaagacacacagtttatttgtaaagtagctctgtgagagccaccatgccctctgcccttgcctcttgggactgaccaggagctgctcatgtgcgtgagagtgggaaccatctccttgcggcagtggcttccgcgtgccccgtgtgctggtgcggttcccatcacgcagacaggaagggtgtttgcgcactctgatcaactggaacctctgtatcatgcggctgaattccctttttcctttactcaataaaagctacatcagactgatgctctttctccagattcttagtctcacctcg

SEQ ID NO: 22389 - DNA, 3180 bp, Homo sapiens
attctatgctgcagcctaagcatcattcctcttctcttcttagtggagataaaattacccactgctctccttacatttactttgtccatatttgctcctatgctctaggctcgtgcacaacaaacacagtgtgggcccttaccctagaagccaacttctcatgacctttctctatctccagaatccatgcagtgggaatgaaggtaaaagaaggttttcatgggatccagctgagagctctacggggaaaatggatctgaggagccatgtgctccatctcttttattttacaggtagagactaggggtatagagtgaggtgaattaccgcagtgacccacacattgttggcagacctaggattagaactctgtcttcctggttcccagcttggtgcttttgaaagcatacttgctgctttcttaccggcctggtgtctgccactttgggacagagtgtggacttgctcacctgccccatttcttagggattctcattctgtgtttgagcaagaatattcttattctggaaagaaccacataccacaggattctgggtgagcataaggaagattgtcttggggatctgacttagctcacgtatagtggctatgatgaattcagtgtcttattttttgcatatgtatatttttagtctaatattgcctgggtgtctgagcaagtctagatgaatttaattgctctcatttttcccctgcccctcttcctttggtctctcttttaggaaatgtttttctttcaacattcgtttcattcattatttactcattcggccaaccaacatttattgagtgccttccctgtatcagggacaggggcttacaaagtagaatttgatcccacctctgccctcagtagctcagtgtctaatggaggtagtgatgttcattaagcgtcgccagatactgtgctaggtgctgtgcctgttctctctcgcttgttcctcacacacttgagaaggccgaagctgattcatagcttggaaggcaggggccttggatttgaacccaggcctgaccaatggcagaacctatcagatgtgtggacagatgacattgcctttctttctttggatatatcaaaatcagccagcaggcaggaactcccattttgagcaagcaatgtgcaggaatgatagggtatacagagaggaacaggagatggcccctgacttccagcatgtgtctgatggacatccaggctgcaggcatcatggtgctgtctagagagatgagccaggtgcccagagcccatgggccaatgctgccctttcttgagcatgccaaacaaagcggttggtgtgttagaggcacagtctcctccactctaagtaaaaatcagcatgagtcctagcccacatttccctagtgagtataccaaagatatctatgaactggcagtcatcagtgacttcctaaggttccggaaatgcatctcttactcaggagtaagcaatgatgtgcctgcggctttacgagttctcacagaatgactttctggacccaaatgttttttctgcttcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctaccccc

SEQ ID NO: 22390 - DNA, 1913 bp, Homo sapiens
gaggaggaggaggagatgactggggagcgggagctggagaatactgcccagttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctacccccaa

SEQ ID NO: 22391 - DNA, 1448 bp, Homo sapiens
gcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtct

SEQ ID NO: 22392 - DNA, 2196 bp, Homo sapiens
agttactctagcgcgccaggccgaaccgcagcttcttggcttaggtacttctactcacagcggccgattccgaggccaactccagcaatggcttttgcaaatctgcggaaagtgctcatcagtgacagcctggacccttgctgccggaagatcttgcaagatggagggctgcaggtggtggaaaagcagaaccttagcaaagaggagctgatagcggagctgcaggactgtgaaggccttattgttcgctctgccaccaaggtgaccgctgatgtcatcaacgcagctgagaaactccaggtggtgggcagggctggcacaggtgtggacaatgtggatctggaggccgcaacaaggaagggcatcttggttatgaacacccccaatgggaacagcctcagtgccgcagaactcacttgtggaatgatcatgtgcctggccaggcctgaaaccttccgggaccaagaaattacttttcccatggcgagacctgctttccctcctgctggaggaggatctgggggaatttacctctgctctaactcctccctgcagtttccatctgagctctctggtattcactgatattcactggaccagctttgtttaaaggaatcggtgaaatgctgtggtttaaaagaagctccccattgtcaactgctcaccatgacctcactcatcaaaggtgcatcaaaactaggaaacacgcacaccctattgggaaggaatgcgttcgtttcatcagactgttcctagcagggaggacggtaggagagtgcagattccccaggcgacggcttcgatgaaggacggcaaatgggagcggaagaagttcatgggaacagagctgaatggaaagaccctgggaattcttggcctgggcaggattgggagagaggtagctacccggatgcagtcctttgggatgaagactatagggtatgaccccatcatttccccagaggtctcggcctcctttggtgttcagcagctgcccctggaggagatctggcctctctgtgatttcatcactgtgcacactcctctcctgccctccacgacaggcttgctgaatgacaacacctttgcccagtgcaagaagggggtgcgtgtggtgaactgtgcccgtggagggatcgtggacgaaggcgccctgctccgggccctgcagtctggccagtgtgccggggctgcactggacgtgtttacggaagagccgccacgggaccgggccttggtggaccatgagaatgtcatcagctgtccccacctgggtgccagcaccaaggaggctcagagccgctgtggggaggaaattgctgttcagttcgtggacatggtgaaggggaaatctctcacgggggttgtgaatgcccaggcccttaccagtgccttctctccacacaccaagccttggattggtctggcagaagctctggggacactgatgcgagcctgggctgggtcccccaaagggaccatccaggtgataacacagggaacatccctgaagaatgctgggaactgcctaagccccgcagtcattgtcggcctcctgaaagaggcttccaagcaggcggatgtgaacttggtgaacgctaagctgctggtgaaagaggctggcctcaatgtcaccacctcccacagccctgctgcaccaggggagcaaggcttcggggaatgcctcctggccgtggccctggcaggcgccccttaccaggctgtgggcttggtccaaggcactacgcctgtactgcaggggctcaatggagctgtcttcaggccagaagtgcctctccgcagggacctgcccctgctcctattccggactcagacctctgaccctgcaatgctgcctaccatgattggcctcctggcagaggcaggcgtgcggctgctgtcctaccagacttcactggtgtcagatggggagacctggcacgtcatgggcatctcctccttgctgcccagcctggaagcgtggaagcagcatgtgactgaagccttccagttccacttctaaccttggagctcactggtccctgcctctggggcttttctgaagaaacccacccactgtgatcaatagggagagaaaatccacattcttgggctgaacgcgggcctctgacactgcttacactgcactctgaccctgtagtacagcaataaccgtctaataaagagcctaccccc

SEQ ID NO: 22393 - DNA, 4887 bp, Homo sapiens
cagcggccgggaaggggcggtgcgggaggcggggtgtggggcggtagtgtgggccctgttcctgcccgcgcggtgttccgcattctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattgaaaccgtgatttttttttttttcctgtcatactttgttaggaagggtgagaatagaatcttgaggaacggatcagatgtctatattgctgaatgcaagaagtggggcagcagcagtggagagatgggacaattagataaatgtccattctttatcaagggcctactttatggcagacattgtgctagtgcttttattctaacttttatttttatcagttacacatgatcataatttaaaaagtcaaggcttataacaaaaaagccccagcccattcctcccattcaagattcccactccccagaggtgaccactttcaactcttgagtttttcaggtatatacctccatgtttctaagtaatatgcttatattgttcacttcttttttttttattttttaaagaaatctatttcataccatggaggaaggctctgttccacatatatttccacttcttcattctctcggtatagttttgtcacaattatagattagatcaaaagtctacataactaatacagctgagctatgtagtatgctatgattaaatttacttatgtaacttttattgtctttggcattaacagtgtttcaaaaaattttctgtgtatacccatcagtgattcattcccaaatcttctagaagcataagtgtctcaatatattaaaacatattgaataatccttgttagagttatccctgcaggagtccttagtgctcctttatccaatttgtacttgatgccctctaggcagggtgtacagctagctgttgctctggtatttcctataaccttcttggggatttcttttacctcctgtgttagactcctgttttctggattcccccttttccctctttcttggtctactttttgtagaacacaagactctactagcttcctgagaaagggtgcctgggaggcaaaatctctaagactttgtaagtctgaaaatgtctttattcgacccttatacttgattcctagtttggctatatatagaattttagcctgagtatcactttttgagactcgaagccactgtttcattgtcactattgagaatctaaatggccattcggattctttcatcatctttataattttaccttcctatttctttcctgtccttttaatggagttttgggagagagcagaggtaaacatgatttgaaaaagccatgtctgaccagaaattctgtgctggaaagatatgtatttcacctttagggacaaagaaataaacttttggacaggaccacagagctagtaagtaacagcagggattcaagtccaggtttgtctggttccagtggctgatgcttttccaatgtgcctccgtccctgacatgatgcttctaggctatagatgcttctagactctatccctgacatgatgcttctagactattttgtttaaccctggatagaatagcaaaagaaaattttggtggttgctctaaacaaaacagaaatttgaaagctcaagttttttcttcatttgtattttagttaatactgtacccatatttgtagttaattttaaattgtaccatgtttctgcatacctctatgggtactcaggaattctagtccaatttttgtgactttttcctactgattacctttcctccaacgttttaaaaattatttcaaatggaactgaaagaagcataaactcccataaacccagcacctagactctacaattgccaacattatctatccaacaatctctgactgtaccttttaagtactttctactggactgtttccaggatcacccctcatttatttgggttgttaacctaaagaatgaatgggggaatctccagtcataaacaacttgtcaattaggcaaatatttgagttccttctatgtgcttaaagacgtgatagagggaatataagagcatttatgttctgaaggaatttttaacctaaccaaagaagatagtagataacttgtgtgcatataagctagaacagtataaggggccgggcatggtggcttacgcctgtaatcccaggactttgggaggccaaggcgggcagatcacctgtcaggagtttgggaccagcctggccaacatggtgaaaccccgtttctaccaaaaatacaaaaattagccgggcgtggtggcgtgtgccactgtagtcccagctattcagaaggctgaggcaggagaatcacttgaacccgggaggtggaggttgcagtgagctgagatcacgctactgcattcctgcttgggcgacagagtgagactctgcctcaaaacaaaaaccccacaaaacagtataaggatgtgctttctaatttggaattatgaattattggtaaaatattgcaaaggtgtatgctttaagttgtaaattcacctttaaccctagactatatatgtgtgtttatatgcagaaaaaaataattcccatgtcgtaagtgaacaatttggttctttagctcagtgttttcctgttttcttcatttccaaaatttccctctagcacaggggtttacacatgatcaaaaaggagtatacaatgaagacaccttcctcagtcccctacctaccagtttccctccccagaagcaacctctggaagaccagtttctttcaatctaaggctatttaatatacattaagaggccgggcgcagtggctcacgcctgtaatcccaacaacactttgggaggcccaggcaggcgggtcatgaggtcaggagattgagaccatcctggctaacacggtgaaaccctgtctctactaaaaatacaaaaaattagctgggcgtgatggtgggcgcctgtagtcccagctactcgggaggctgaggcaggagaatggcgtgaacctgggaagcggagctcgcagtgagccgagatcacgccactgcactccagcctgggcaacagtgagactctgcataaagagcatacccatgtgtgtacctatctatctatctatctatctatctatctatctatctatctgtatatagatatattaaaatgtaaatggtggcat

SEQ ID NO: 22394 - DNA, 1366 bp, Homo sapiens
attctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgttaaaaagaaagtgagcagtgttagcttagttctcttttgatgtaggttattatgattagctttgtcactgtttcactactcagcatggaaacaagatgaaattccatttgtaggtagtgagacaaaattgatgatccattaagtaaacaataaaagtgtccattg

SEQ ID NO: 22395 - DNA, 1405 bp, Homo sapiens
attctgcaagcctccggagcgcacgtcggcagtcggctccctcgttgaccgaatcaccgacctctctccccagctgtatttccaaaatgtcgctttctaacaagctgacgctggacaagctggacgttaaagggaagcgggtcgttatgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagatt

SEQ ID NO: 22396 - DNA, 1769 bp, Homo sapiens
aacctggataccttctacttatttaggctgaggacaggaagttacatggttccctgattattaatgtatttcttttgaacagagagtcacattgtaggcctacttttttggaggtgcttaggcagccatgtggtgtcagctcaattcctttttgtttcaacgtggtggttgctggcggtgtttccggaatggggcttcctgagtagtggctgcctcatttgtcgtctttgtcctgcagaagtgaactatggtatttgctgactcttctggtccactggtttggattgccaagggaaattgatttgttgagagtcgacttcaatgttcctatgaagaacaaccagataacaaacaaccagaggattaaggctgctgtcccaagcatcaaattctgcttggacaatggagccaagtcggtagtccttatgagccacctaggccggcctgatggtgtgcccatgcctgacaagtactccttagagccagttgctgtagaactcaaatctctgctgggcaaggatgttctgttcttgaaggactgtgtaggcccagaagtggagaaagcctgtgccaacccagctgctgggtctgtcatcctgctggagaacctccgctttcatgtggaggaagaagggaagggaaaagatgcttctgggaacaaggttaaagccgagccagccaaaatagaagctttccgagcttcactttccaagctaggggatgtctatgtcaatgatgcttttggcactgctcacagagcccacagctccatggtaggagtcaatctgccacagaaggctggtgggtttttgatgaagaaggagctgaactactttgcaaaggccttggagagcccagagcgacccttcctggccatcctgggcggagctaaagttgcagacaagatccagctcatcaataatatgctggacaaagtcaatgagatgattattggtggtggaatggcttttaccttccttaaggtgctcaacaacatggagattggcacttctctgtttgatgaagagggagccaagattgtcaaagacctaatgtccaaagctgagaagaatggtgtgaagattaccttgcctgttgactttgtcactgctgacaagtttgatgagaatgccaagactggccaagccactgtggcttctggcatacctgctggctggatgggcttggactgtggtcctgaaagcagcaagaagtatgctgaggctgtcactcgggctaagcagattgtgtggaatggtcctgtgggggtatttgaatgggaagcttttgcccggggaaccaaagctctcatggatgaggtggtgaaagccacttctaggggctgcatcaccatcataggtggtggagacactgccacttgctgtgccaaatggaacacggaggataaagtcagccatgtgagcactgggggtggtgccagtttggagctcctggaaggtaaagtccttcctggggtggatgctctcagcaatatttagtactttcctgccttttagttcctgtgcacagcccctaagtcaacttagcattttctgcatctccacttggcattagctaaaaccttccatgtcaagattcagctagtggccaagagatgcagtgccaggaacccttaaacagttgcacagcatctcagctcatcttcactgcaccctggatttgcatacattcttcaagatcccatttgaattttttagtgactaaaccattgtgcattctagagtgcatatatttatattttgcctgtt

SEQ ID NO: 22397 - DNA, 1688 bp, Homo sapiens
aacagtggccgttgtgctggagacagtgaggagaagaaaggggcgggacaagggcaaaggcgttagaagtcaccaccgacccagcccctcaacagcaagttggttcttcagcattaagatccaggtgtcagcctatgtctttatattgtcaagatgtctctttctaagaagttgactttagacaaactggatgttagagggaagcgagtcatcatgagagtagacttcaatgttcccatgaagaagaaccagattacaaacaaccagaggatcaaggcttccatcccaagcatcaagtactgcctggacaatggagccaaggcagtagttcttatgagtcatctaggtcggcctgatggtgttcccatgcctgacaaatattccttagcacctgttgctgttgagctcaaatccttgctgggcaaggatgttctgttcctgaaggactgtgtaggcgcagaagtggagaaagcctgtgccaacccagctcctggttcagtcatcctgctggagaacctgcgctttcatgtggaggaagaagggaagggccaagatccctctggaaagaagattaaagctgagccagataaaatagaagccttccgagcatcactttccaagctaggggacgtctatgtcaatgatgcttttggcactgcacaccgcgctcatagttccatggtgggagtgaatctgccccataaagcatccggattcttgatgaagaaggaactagattactttgctaaagccttggaaaacccagtgagaccctttctggctatacttggtggagccaaagtggcagacaagatccaacttatcaaaaatatgctggacaaagtcaatgagatgattattggtggtggaatggcttataccttccttaaggtactcaacaacatggagattggtgcttccctgtttgatgaagagggagccaagatcgttaaagatatcatggccaaagcacaaaagaatggtgtaaggattacttttcctgttgattttgttactggggacaagtttgacgagaacgctcaggttggaaaagccactgtagcatctggcatatctcctggctggatgggtttggactgtggtcctgagagcaacaagaatcatgctcaagttgtggctcaagcaaggctaattgtttggaatgggccgttaggagtatttgaatgggatgcctttgctaagggaaccaaagccctcatggatgaaattgtgaaagccacttccaagggctgcatcactgttatagggggtggagacactgctacttgctgtgccaaatggaacactgaagataaagtcagccatgtcagcactggaggcggtgccagtctagagcttctggaaggtaaaatccttcctggagtagaggccctcagcaacatgtagttaatatagtgttacttccttctgttttctgtccatggcccttaagtcagcttaatgcttttacatctcgatgtgacttttgttaaaatctactcctagatcaagacctatgtaatggacaagcagcaggccatcaggaactcttaatatcagcacagcaattcattttagtttggtcacgcatttgcctgttcaagttctcatttgaacttcaccattgtgctatctagggaggacatattcttaagttgcctattaaagaaagtgagctgaagaaactg

SEQ ID NO: 22398 - DNA, 1830 bp, Homo sapiens
agcggtccagagcgagtggaaagatttgggcgagaacttgcgcgggagccggactgagcggtgcgagcgcgcaggcgcggccgacggggcgggctgctactccggaatctgctaatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagacggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtatctttcactgatttctgaatcatgttctagttgcttgaccctgccacatgggtccagtgttcatctgagcataactgtactaaatcctttttccatatcagtataataaaggagtgatgtgcaata

SEQ ID NO: 22399 - DNA, 1385 bp, Homo sapiens
aatcccagtcggtgccgcatccccagcccgccgccatggccgcctacaaactggtgctgatccggcacggcgagagcgcatggaacctggagaaccgcttcagcggctggtacgacgccgacctgagcccggcgggccacgaggaggcgaagcgcggcgggcaggcgctacgagatgctggctatgagtttgacatctgcttcacctcagtgcagaagagagcgatccggaccctctggacagtgctagatgccattgatcagatgtggctgccatgatgtcccaccacctccgatggagcccgaccatcctttctacagcaacatcagtaaggatcgcaggtatgcagacctcacagaagatcagctaccctcctgtgagagtctgaaggatactattgccagagctctgcccttctggaatgaagaaatagttccccagatcaaggaggggaaacgtgtactgattgcagcccatggcaacagcctccggggcattgtcaagcatctggagggtctctctgaagaggctatcatggagctgaacctgccgactggtattcccattgtctatgaattggacaagaacttgaagcctatcaagcccatgcagtttctgggggatgaagagacggtgcgcaaagccatggaagctgtggctgcccagggcaaggccaagaagtgaaggccggcggggaggatactgtccccaggagcaccctccctgcccgtcttgtccctctgcccctcccacctgcacatgtcacactgaccacatctgtagacatcttgagttgtagctgcagacggggaccagtggctcccattttcattttagccattttgtcgcctgcacccactcccttcatacaatctagtcagaatagcagttctagagcacaggttctcagtctaagctatggaaaagctccccttatccaacagagtttaaaagtagtgacttgggtttttgcgagtgctttgtttactaaggactttggggaggaaccatgctaagccatgaccagtgaggagaagcaacagagcctgtctgtccccatgagcggagtctgtcctctgctcttctgcagtcaggtcactgcctactgcctgggggctctagtcattccagtggaagacgaatgtaacctgcgtggtgatgtgacaactgtttcctccctgaccccagaggatctggctctaggttgggatcaatcctgaatttcgttatgtgttaatttacttttattaaaaaagtatagtatatataatacaaaacaataacccttctggggtttcttgtggcggttgaaatagtcccacatgtggtcatcagaaaataagccattcctcataccaatataggatcagctccttgacctctga

SEQ ID NO: 22400 - DNA, 857 bp, Homo sapiens
gggagtgttgggaagcagccgtccccgtccagagtcctctgtggtccctgctgccaccatggccactcaccgcctcgtgatggtccggcacggcgagagcacatggaaccaggagaaccgtttctgtggctggttcgatgcagagctgagtgaaaaggggaccgaggaggccaagcggggagccaaggccatcaaggatgccaagatggagtttgacatctgctacacgtcagtgctgaagcgggccatccgcaccctctgggccatcctggacggcacggaccagatgtggctgcctgtggtgcgcacttggcgcctcaatgagcggcattacgggggcctcacaggcctcaacaaggcagaaacggccgccaagcacggggaggagcaggtgaagatctggaggcgctccttcgacatcccgccgcccccgatggacgagaagcacccctactacaactccattagcaaggagcgtcggtacgcaggcctgaagcccggggaactccccacctgcgagagcctcaaggacaccattgcccgggccctgcccttctggaacgaggagattgttccccagatcaaggccggcaagcgagtgctcattgcagcccacgggaacagcctgcggggcattgtcaagcacctggaagggatgtcagaccaggcgatcatggagctgaacctgcccacggggatccccattgtgtatgagctgaacaaggagctgaagcccaccaagcccatgcagttcctgggtgatgaggaaacggtgcggaaggccatggaggctgtggctgcccagggcaaggccaagtgaggggtgggcttgggcaataaaggcacctcccccaaca

SEQ ID NO: 22401 - DNA, 1678 bp, Homo sapiens
atggccgcctacaaactggtgctgatccggcacggcgagagcacatggaacctggagaaccgcttcagctgctggtacgacgccgatctgagcccggcgggccacgaggaggcgaagcgcggcgggcaggcgctacgagatgctggctatgagtttgacatctgcctcacctcagtgcagaagagagtgatccggaccctctggacagtgctagatgccattgatcagatgtggctgccagtggtgaggacttggcgcctcaatgagcggcactatgggggtctaaccggtctcaataaagcagaaactgctgcaaagcatggtgaggcccaggtgaagatctggaggcgctcctatgatgtcccaccacctccgatggagcccgaccatcctttctacagcaacatcagtaaggatcgcaggtatgcagacctcacagaagatcagctaccctcctatgagagtccgaaggatactattgccagagctctgcccttctggaatgaagaaatagttccccagatcaaggaggggaaacgtgtactgattgcagcccatggcaacagcctccagggcattgccaagcatgtggagggtctctctgaagaggctatcatggagctgaacctgccgactggtattcccatcgtctatgaattggacaagaacttgaagcctatcaagcccatgcagtttctgggggatgaagagacggtgtgcaaagccatagaagctgtggctgcccagggcaaggccaagaagtgaaggccagcggggaggatactgtccccaggagcaccctccctgctggtcttgtccctctgcccctcccacctgcacatgtcacactgaccacatctgtagacatcttgagttgtagctgcagatggggaccagtggctcccattttcattttagccattttgtcgcctgcacccactcccttcatacaatctagtcagaatagcagttctagagcacaggttctcagtctaagctgtggaaaagctccccttatccaacagagtttaaaagtagtgacttgggtttttgtgagtgctttgtttactaaggactttggggaggaacatgctaagccacgaccaatgaggagaagcaacagagcctgtctgtccccatgagcagagtctgtcctctgctcttctgcagtcaggccactgcctgggggctctagtcattccagtggaagatgaatgtaatctgcatggtgatgtgacaactgtttcctccttgaccccagaggatctggctctaggttgggatcaatcctgaatttcgttatgtgttatatttacttttattaaaaaagtatagtatatattaataatacaaaacaataacccttctggggtttcttgtggcggttgaaatagtcccacatgtggtcatcagaaaataagccattcctcataccaatataggatcagctccttgacctctgaggggcaggagtgcttcctggtgtgtgtattagaatcccttcctgccttgtttcatggcagtgaaatgcctcttggtcctgtccaagtgtgtctttcactgatttctgaatcatgttctagttgcttgaccctgccacatgggcccagtgttcatctgagcataactgtactaaatccttttaccagatcagtataataaaggagtgatgtgcaat

SEQ ID NO: 22402 - DNA, 3136 bp, Homo sapiens
gctgcgaggagcggccggcgggcggcggcggccggcgggcggcgatggcggcggcggaggccggtggcgacgacgcccgctgcgtgcggctgagcgccgagcgggcacaggcgctgctggccgacgtggacacgctgctgttcgactgcgacggcgtgctgtggcgcggggagaccgccgtgcctggcgcgcccgaggccctgcgggcgctgcgagcccgcggcaagcgcctgggcttcatcaccaacaacagcagcaagacccgcgctgcctacgccgagaagctgcggcgcctgggcttcggcggccccgcggggcccggcgccagcctggaggtcttcggcacggcctactgcaccgcgctctacctgcgccagcgcctggccggcgcccccgcgcccaaggcctacgtgctgggcagcccagccctggccgcggagctggaggccgtgggcgtcgccagcgtgggcgtggggcccgagccactgcagggcgagggtcccggcgactggctgcacgcgccgctggagcccgacgtgcgcgcggtggtggtgggctttgacccgcacttcagctacatgaagctcaccaaggccctgcgctacctgcagcagcccggctgcctgctcgtgggcaccaacatggacaaccggcttccgcttgagaacggccgcttcatcgcgggtaccgggtgtctggtccgagccgtggagatggccgcccagcgccaggccgacatcatcgggaagcccagccgcttcattttcgactgcgtgtcccaggaatacggcatcaaccccgagcgcaccgtcatggtgggagaccgcctggacacagacatcctcctaggcgccacctgtggcctgaagaccatcctgaccctcaccggagtctccactctaggggatgtgaagaataatcaggaaagtgactgcgtgtctaagaagaaaatggtccctgacttctatgttgacagcatagccgaccttttgcctgcccttcaaggttaaagattgagtgtctttaatctgcagaataaaaaaaaagaaattgaaaaccagttacccaaattaataggtggggcttaagcatctgctcggctaagtggcttcaaagagtgtaattggagttaagcaaaggcattcattgttaaccttgtaagtacacgtttgggggacgattttgtttacagatgcttgtaatcgaagatgcacttttaggcttggaaggcgttgtgggctgggttctgggccttgggtggggttggcaggggcaggctctgcacctgtccgggattcaggtaaccagggcctgccgatgggactgaggcgggtctaggggtgtgtgtcctgtattttattgaaaaactcattcagggatccagcccctcagggggcagagggactgattattctgactgttgggagaggcttgcatggaccagagccccatcagtatgactgaaagtccagcggagccttctgtgtccctgtgcctcccagcagggtgggagtggaggaggcggctgctcccaggtggcatctccctgcccttgggtgcaaagtgctgccctcaccactctcccacctcccttacttccttgaaaaccactctgatgtcacaactgagtgtctgttccgtttcagatacccagggctgctgcccagttctgtaaacgcagcccagctaaagctctgctgtctcaagtgtgcatttatacccaggtgatttggacggagcagctaccatggcgtggacgccttcactgaactccgggctgcagtgcagggagctcagagcagtgctgctaccagtttttaactttgaacaactgtgtcaggcaatggatttgaattttaagtgtattaatagctgtgctctgtgtcgtaggcaaaattccactgaaggagcctctgtgccctgcagccggcagcgcggctgaagcatgtgttggccaaggaatgcctgtcatccaggtgccctgcagccagcagcgcggctcaagcatgtgttggccaaggaatgcctgtcagtcatccagggctctgggaggggacgagagttatgtccccaagaacaggaagtcctttacaaagcatccagtctcttcctgtcctccccttccctaggctggggtaggggttagagactggtggcccaggaggtcacctgccttgccctggattccctcttcagtggccagcaggacttggcagggccaccagctcgccaaggttctgggcggggctccagcctctcctgcctgctccttggctctgctgacctttcacaggcctgacagcagactcagcagggccatcccgggatgctgcaccttctggctggctccctaccagcgcctttccctgtacctggcagcttctctcttggccccacagtcacagcactccacttggtcacaaagacttcagagcaataagaggcgtcctgagccttcagcacctcccaggcctgggatatcgggttcagagggtgctgcagagcagcatgagggtggctccacccatgaggctggtgacactgacgctggcttggctaagttggctcaagccgggtctggcctgacagggtgcagtcacaccaggagcgcatggcagatgcagcctcagtgatgcctctcttgccgggtaggggctgggagtccccgtgcatcctgtctctggcccatgaggggctgcagcactgtgggcgccagagcacagattaaactctcaaacccacactggctcaggtgtccttgctctcaccttgcattggcccgggtgatgccgtctcaccacgggtgggaggactcaaagtagatgggtaactggggttccaactccagagctggaatgccaactgcccactcccagcctggttcagaggaagatgttttgaagaatgagggaaagccaggcacaaagggaagccagggaagcaaagggccctggagtgaagctggtgggctgccgtgtcagagcgcccagggcagggagcagagctcagaagtaatgctggcccgggcgcagtggctcacacccgtaatcccaacgctttggaaggctgaggcaggtggattacttgagatcaggagttcaagaccagcctggccaaaatggtgaaaacccatctc

SEQ ID NO: 22403 - DNA, 890 bp, Homo sapiens
ctccctcgttgccccagcctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 22404 - DNA, 985 bp, Homo sapiens
ggccgggaacgcccctggaccggaataatttccagggggcaagagctttcgaaccaacctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatgatgagacccacgtgcgtccctctgggcgcctcaggccccaggatccaccatcaaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccaca

SEQ ID NO: 22405 - DNA, 1249 bp, Homo sapiens
ggctgccgttgcctccttgtaccggtagcggggttggggacggaagccttcggtcggtggagaggagaaagggagaggccttcgggcggtggacggggaagagagggagtccttcgggcggtggagggggtggagagcgaggccttcgggcggtggagagcggggaggggggaggccttcgggcggtgggagggggagagagggaggcctttgggcggtgggggccacggggagggtggtcttcggactacgtgcgggacaggaggtcagggctggcaagtccctcaggcctccctcgttgccccagcctcgcgggccgcctaactgccccgttccaagggtgccaccggaccccgctggagaggaacttctccgttggctggatttcatcaccacccattcccgattccacgtttcctttaagcggggctggcggagccgcaaggcggcaaggaactggattgcgattggtcagcacgtgcctcggtcggcggtacaattggctgaggcgctgggccttgggaagcattccccgacgggattggtcgtcgctctcgcagagcccgcctcccgcagtacaagcggcccccgggtcgggtgggaggaggggactccgggaggaggaacatggcggtggcggacctcgctctcattcctgatgtggacatcgactccgacggcgtcttcaagtatgtgctgatccgagtccactcggctccccgctccggggctccggctgcagagagcaaggagatcgtgcgcggctacaagtgggctgagtaccatgcggacatctacgacaaagtgtcgggcgacatgcagaagcaaggctgcgactgtgagtgtctgggcggcgggcgcatctcccaccagagtcaggacaagaagattcacgtgtacggctattccatgatgagacccacgtgcgtccctctgggcgcctcaggccccaggatccaccatcaaggcctatggtcctgcccagcacgccatttcaactgagaaaatcaaagccaagtaccccgactacgaggtcacctgggctaacgacggctactgagcactcccagcccggggcctgctgcctccagcagccacttcagagcccccgcctttgcctgcactcctcttgcagggctggccctgcctgctcctgcggcagcctctggtgacgtgctgtccaccaggccttggagacaggctagcctggccacagaattaaacgtgttgccacacctgccggcttctg

SEQ ID NO: 22406 - DNA, 2039 bp, Homo sapiens
caaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaaggtaggaggtagtcaccatctggaatccaaacacaggctggacagctgggccataggatctcatgccagcctgtccttctggcttcctctgtcccacgtggctgagggtatttggtgtgggttttgttctaccctttctcatttctcccacacctcctccccataccttttttggttgattccttttatttcttgttttctccctcagcaccaccatgcccagtgtaaagcttgtagtctttaaaaggaactacatctgactgctcttcccataatgtgcaacttccaaggtggcatttctttgcatttataacatggatgttctgctctattcttttctctttcttcatttaacattttaaagcctatttgcctttgccgttacccagtaacataatatttcactaaacccattaagatgcttgaactagattgggggaaaatcattcacacattccaaaatatctccataataattcataatgcttattatgtatattctatatttattaaaacaatttcttctctaatgtaaaa

SEQ ID NO: 22407 - DNA, 1898 bp, Homo sapiens
gcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggatagtgacctgaaacaatactggatgccagatagccaatgtaaagagtgctatgactgtagtgagaaatttacaacctttaggcgcagacaccattgccgactatgtgggcagattttctgcagtcgttgctgtaatcaagaaatccctggaaaatttatgggctatacaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaaggtaggaggtagtcaccatctggaatccaaacacaggctggacagctgggccataggatctcatgccagcctgtccttctggcttcctctgtcccacgtggctgagggtatttggt

SEQ ID NO: 22408 - DNA, 9901 bp, Homo sapiens
caaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggatagtgacctgaaacaatactggatgccagatagccaatgtaaagagtgctatgactgtagtgagaaatttacaacctttaggcgcagacaccattgccgactatgtgggcagattttctgcagtcgttgctgtaatcaagaaatccctggaaaatttatgggctatacaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaattctgccagtcctagcaagcgcacatcagtcagcagtttccagtccacagtggacagtgactcagccgcttctatcagcctgaacgtggagctggacaacgtgaacttccatatcaagaagccctccaagtacccacatgtgccccctcaccctgctgaccaaaaagagtatttgatttctgacactggaggacaacagctctcaataagtgacgctttcatcaaagaatccttatttaatcgccgagtagaggaaaaatccaaagagctgcctttcacacctttgggctggcatcataacaacctggagctcctgagggaggagaatggggagaaacaagccatggagaggttgctttcagctaatcataaccacatgatggcactactccagcagttgctccatagtgactcactgtcatcatcttggagggacatcatcgtgtcattggtctgccaggttgttcagacagtccgacctgatgtcaagaaccaggatgatgacatggatatccgtcagtttgtccacatcaaaaaaatcccaggtggaaagaagtttgattctgtggttgtcaatggctttgtttgtaccaagaacattgcacataaaaagatgagttcttgtattaaaaaccccaaaattcttctgttgaagtgttccattgagtatctctacagagaagaaactaagtttacttgcattgatcctattgtgcttcaggaaagggaattcttgaagaattatgtccagcgaatagttgatgttcgacccaccttggttcttgttgagaaaacagtgtctcggattgcccaggacatgttattggaacatggcattactttggtcattaatgtaaagtcacaagttttggaacgaatcagtcgaatgacccaaggtgatttagtgatgtcaatggaccagctgcttacgaaaccacacctgggcacttgtcacaaattttatatgcagatatttcagttgcctaatgaacaaaccaagacactgatgttttttgaaggttgtccacagcacctaggctgtacaatcaagctaagaggaggctctgattatgagctggctcgagttaaggagatcctaatatttatgatctgtgttgcttatcattctcaactagaaatatcctttctcatggatgaatttgctatgcctcccacattaatgcaaaacccttcattccattccctgattgagggacgagggcatgagggggctgtccaagagcagtacggtggaggttccatcccctgggatcctgacatccctcctgagtctctgccctgtgatgatagcagtttgctggaattgaggattgtgtttgagaagggtgagcaggaaaataaaaatcttccgcaggctgttgcctctgtgaagcatcaagaacatagcacaacagcttgcccggcgggtctcccttgtgctttctttgcacctgtaccggaatcattgttgccactccctgtggatgaccaacaagatgctttaggcagcgagcagccagagactttgcagcaaacagttgtgctgcaggatcccaaaagccagataagagcctttagagaccctctacaggatgacactggattatatgttactgaggaagtcacctcctctgaagataaacgaaagacttattctttggcctttaagcaggaattaaaagatgtgatcctctgtatctccccagtaatcacattccgagaaccctttcttttaactgaaaaggggatgagatgctctacccgagattattttgcagagcaggtttactggtctcctctcctcaataaagaattcaaagaaatggagaacaggaggaagaaacagctgctcagggatctctctggacttcagggcatgaatggaagtattcaggccaagtctattcaagtcttaccctcacatgagctagtgagcactagaattgctgagcatctgggcgatagccagagcttgggtagaatgctggccgattatcgagccagaggaggaagaattcagcccaaaaattcagacccttttgctcattcaaaggatgcatcaagtacttcaagtggccaatcaggaagcaaaaatgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatttgcaaaataccttgaacttaggttttatgggcaccagtatactcgcagagccaacgctgagccctgtggtcactccatccatcatgattatcaccagtatttctcctataaccagatggtggcgtctttcagttattctcccattcggcttcttgaagtatgtgttccactccccaaaatattcattaagcgtcaggccccattaaaagtgtcccttcttcaggatctgaaggacttctttcaaaaagtttcacaggtatatgttgccattgatgaaagacttgcatctttgaaaactgatacatttagtaaaacaagagaggaaaaaatggaagatatttttgcacagaaagagatggaagaaggtgagttcaagaactggattgagaagatgcaagcaaggctcatgtcttcctctgtagatacccctcagcaactgcagtcggtctttgagtcactcattgccaagaaacaaagtctctgtgaagtgctgcaagcttggaataacaggttgcaggaccttttccaacaggaaaagggtagaaagagaccttcagttcctccaagtcctggaagactgagacaaggggaagaaagcaagataagtgcgatggatgcatctccacggaatatttctccaggacttcagaatggagaaaaagaggatcgcttcttaacaactttgtccagccagagctccaccagttctactcatctccaattgcctacgccacctgaagtcatgtctgaacagtcagtgggagggccccctgagctagatacagccagcagttccgaagatgtgtttgatgggcatttgctgggatccacagacagccaagtgaaggaaaagtcaaccatgaaagccatctttgcaaatttgcttccaggaaatagctataatcctattccatttccttttgatccagataaacactacttaatgtatgaacatgaacgagtgcccattgcagtctgcgagaaggaacccagctccatcattgcttttgctctcagttgtaaagaataccgaaatgccttagaggaattgtctaaagcgactcagtggaacagtgccgaagaagggcttccaacaaatagtacttcagatagcagaccaaagagtagcagccctatcagattacctgaaatgagtggaggacagacaaatcgtacaacagaaacagaaccacaaccaaccaaaaaggcttctggaatgttgtccttcttcagagggacagcagggaaaagccccgatctctcttcccagaagagagagaccttacgtggagcagatagtgcttactaccaggttgggcagacgggcaaggaggggaccgagaatcaaggcgttgagcctcaagatgaagtagatggaggagatacacaaaagaagcaactcataaatcctcatgtggaacttcaattttcagatgctaatgccaagttttactgtcggctctactatgcgggagagtttcataagatgcgtgaagtgattctggacagcagtgaagaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtggctgtttagactgtccgtaatggaatggtaaaactccatgaatttgcactttggtttttgatacctgtggagctgtctgtaggttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccggttaaacacgtgggcatttattgttttattgaggaatttgacttaaactgggaatcctgtcatgttgtttatctttccagcttgcctgtttttgagtatgtttgatgtttttaaaattttgtcttctctgtggaagacaggaggctacagcaattaactttaagcctccttttagagatatttttaaaacttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgacgaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgtttttggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttactttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactcca

SEQ ID NO: 22409 - DNA, 9733 bp, Homo sapiens
caaccatgtaagcagcttcgcttcctgccgcaaccgtccgcggcctgaggagcccaccgccgctctcgggggccgacttccgggggctgagccgttgaagcggaggctggggcggggggcagccggcgcggccggggcaggaggcgcagactcatgaaatggccacagatgataagacgtccccaacactggactctgctaatgatttgcctcgatctcctactagtccttctcatctcacacactttaaacctttgactcctgatcaagatgagcccccttttaaatcagcttatagttcttttgtaaatctctttcgttttaacaaagagagagcagaaggaggccagggagaacagcagcctttgagtggaagttggaccagccctcagctcccttcgaggacacagtctgttaggtcacccacaccttataaaaagcagcttaatgaggaactccagcggcgctcttcagcattagacacaagaaggaaagcagaacctacctttggaggtcatgaccctcgtacagctgttcagcttcgaagcctcagcacagtattaaaacgcctcaaggaaatcatggaggggaaaagccaggatagtgacctgaaacaatactggatgccagatagccaatgtaaagagtgctatgactgtagtgagaaatttacaacctttaggcgcagacaccattgccgactatgtgggcagattttctgcagtcgttgctgtaatcaagaaatccctggaaaatttatgggctatacaggagacctccgagcttgcacatattgtagaaaaatagccttaagttatgctcattccacagacagtaattctattggggaagacttgaatgctctttcagattctgcttgctctgtgtctgtgcttgatccaagtgaaccccgaacacctgttgggagtaggaaagccagccgtaacatatttttagaggatgatttggcctggcaaagtttgattcatccagattcctcaaatactcctctttcaacaagacttgtatctgtgcaagaggatgctgggaaatctcctgctcgaaatagatcagccagcattactaacctgtcactggatagatctggttctcctatggtaccttcatatgagacatctgtcagtccccaggctaaccgaacatatgttaggacagagaccactgaggatgaacgcaaaattcttctggacagtgtgcagttaaaagacctgtggaaaaaaatctgccatcacagcagtggaatggagtttcaggatcaccgctactggttgagaacgcatcccaactgcattgtaggaaaggaattagtcaactggctaatccgaaatgggcatattgccacaagggcacaagctatagcaattggacaagcaatggttgatggacgttggctggattgtgttagtcatcacgaccagcttttcagagatgagtatgcgctgtatagaccactgcagagtacagaattttctgagacgccttctcccgacagtgactcagtgaactccgtggaaggacactctgagccatcctggtttaaagacataaagtttgatgacagtgacacagaacagatagctgaagaaggtgacgataatttggctaagtatttgatttctgacactggaggacaacagctctcaataagtgacgctttcatcaaagaatccttatttaatcgccgagtagaggaaaaatccaaagagctgcctttcacacctttgggctggcatcataacaacctggagctcctgagggaggagaatggggagaaacaagccatggagaggttgctttcagctaatcataaccacatgatggcactactccagcagttgctccatagtgactcactgtcatcatcttggagggacatcatcgtgtcattggtctgccaggttgttcagacagtccgacctgatgtcaagaaccaggatgatgacatggatatccgtcagtttgtccacatcaaaaaaatcccaggtggaaagaagtttgattctgtggttgtcaatggctttgtttgtaccaagaacattgcacataaaaagatgagttcttgtattaaaaaccccaaaattcttctgttgaagtgttccattgagtatctctacagagaagaaactaagtttacttgcattgatcctattgtgcttcaggaaagggaattcttgaagaattatgtccagcgaatagttgatgttcgacccaccttggttcttgttgagaaaacagtgtctcggattgcccaggacatgttattggaacatggcattactttggtcattaatgtaaagtcacaagttttggaacgaatcagtcgaatgacccaaggtgatttagtgatgtcaatggaccagctgcttacgaaaccacacctgggcacttgtcacaaattttatatgcagatatttcagttgcctaatgaacaaaccaagacactgatgttttttgaaggttgtccacagcacctaggctgtacaatcaagctaagaggaggctctgattatgagctggctcgagttaaggagatcctaatatttatgatctgtgttgcttatcattctcaactagaaatatcctttctcatggatgaatttgctatgcctcccacattaatgcaaaacccttcattccattccctgattgagggacgagggcatgagggggctgtccaagagcagtacggtggaggttccatcccctgggatcctgacatccctcctgagtctctgccctgtgatgatagcagtttgctggaattgaggattgtgtttgagaagggtgagcaggaaaataaaaatcttccgcaggctgttgcctctgtgaagcatcaagaacatagcacaacagcttgcccggcgggtctcccttgtgctttctttgcacctgtaccggaatcattgttgccactccctgtggatgaccaacaagatgctttaggcagcgagcagccagagactttgcagcaaacagttgtgctgcaggatcccaaaagccagataagagcctttagagaccctctacaggatgacactggattatatgttactgaggaagtcacctcctctgaagataaacgaaagacttattctttggcctttaagcaggaattaaaagatgtgatcctctgtatctccccagtaatcacattccgagaaccctttcttttaactgaaaaggggatgagatgctctacccgagattattttgcagagcaggtttactggtctcctctcctcaataaagaattcaaagaaatggagaacaggaggaagaaacagctgctcagggatctctctggacttcagggcatgaatggaagtattcaggccaagtctattcaagtcttaccctcacatgagctagtgagcactagaattgctgagcatctgggcgatagccagagcttgggtagaatgctggccgattatcgagccagaggaggaagaattcagcccaaaaattcagacccttttgctcattcaaaggatgcatcaagtacttcaagtggccaatcaggaagcaaaaatgagggtgatgaagagagagggcttattctgagtgatgctgtgtggtcaacaaaggtggactgtctgaatcccattaatcaccagagactttgtgtgctcttcagcagctcttctgcccagtccagcaatgctcctagtgcctgtgtcagtccttggattgtaacaatggaattttatggaaagaatgatcttacattaggaatatttttagagagatactgtttcaggccttcttatcagtgtccaagcatgttctgtgatacccccatggtacatcatattcggcgctttgttcatggccaaggctgtgtgcagataatcctgaaggagttggattctccagtacctggatatcagcatacaattcttacatattcctggtgtagaatctgcaaacaggtaacaccagttgttgctctttccaatgagtcctggtctatgtcatttgcaaaataccttgaacttaggttttatgggcaccagtatactcgcagagccaacgctgagccctgtggtcactccatccatcatgattatcaccagtatttctcctataaccagatggtggcgtctttcagttattctcccattcggcttcttgaagtatgtgttccactccccaaaatattcattaagcgtcaggccccattaaaagtgtcccttcttcaggatctgaaggacttctttcaaaaagtttcacaggtatatgttgccattgatgaaagacttgcatctttgaaaactgatacatttagtaaaacaagagaggaaaaaatggaagatatttttgcacagaaagagatggaagaaggtgagttcaagaactggattgagaagatgcaagcaaggctcatgtcttcctctgtagatacccctcagcaactgcagtcggtctttgagtcactcattgccaagaaacaaagtctctgtgaagtgctgcaagcttggaataacaggttgcaggaccttttccaacaggaaaagggtagaaagagaccttcagttcctccaagtcctggaagactgagacaaggggaagaaagcaagataagtgcgatggatgcatctccacggaatatttctccaggacttcagaatggagaaaaagaggatcgcttcttaacaactttgtccagccagagctccaccagttctactcatctccaattgcctacgccacctgaagtcatgtctgaacagtcagtgggagggccccctgagctagatacagccagcagttccgaagatgtgtttgatgggcatttgctgggatccacagacagccaagtgaaggaaaagtcaaccatgaaagccatctttgcaaatttgcttccaggaaatagctataatcctattccatttccttttgatccagataaacactacttaatgtatgaacatgaacgagtgcccattgcagtctgcgagaaggaacccagctccatcattgcttttgctctcagttgtaaagaataccgaaatgccttagaggaattgtctaaagcgactcagtggaacagtgccgaagaagggcttccaacaaatagtacttcagatagcagaccaaagagtagcagccctatcagattacctgaaatgagtggaggacagacaaatcgtacaacagaaacagaaccacaaccaaccaaaaaggcttctggaatgttgtccttcttcagagggacagcagggaaaagccccgatctctcttcccagaagagagagaccttacgtggagcagatagtgcttactaccaggttgggcagacgggcaaggaggggaccgagaatcaaggcgttgagcctcaagatgaagtagatggaggagatacacaaaagaagcaactcataaatcctcatgtggaacttcaattttcagatgctaatgccaagttttactgtcggctctactatgcgggagagtttcataagatgcgtgaagtgattctggacagcagtgaagaagatttcattcgttccctctcccactcatcaccctggcaggcccggggaggcaaatcaggagctgccttctatgcaactgaggatgatagatttattttgaagcaaatgcctcgtctggaagtccagtccttcctcgactttgcaccacattacttcaattatattacaaatgctgttcaacaaaagaggcccacggcgttggccaaaattcttggagtttacagaattggttataagaactctcagaacaacactgagaagaagttagatctccttgtcatggaaaatcttttctacgggagaaagatggcacaggtttttgatttgaagggctctcttaggaatcggaatgtaaaaactgacactggaaaagagagttgtgatgtggtcctgctagatgaaaatctcctaaagatggttcgagacaaccctctatatattcgttctcattccaaagctgtgctgagaacctcgatccatagtgactcccatttcctttctagccacctcattatagattattctttgctggttgggcgagatgatactagcaatgagctagtagttggaattatagattatattcgaacatttacatgggacaaaaagcttgagatggttgtgaaatcaacaggaattttaggtggacaaggtaaaatgccaacagtggtgtctccggagttgtacaggactaggttttgtgaggcaatggacaagtatttcctaatggtaccagaccactggacaggcttgggtctgaattgctgaaatcaagcacatattttgaaatggactgtgaaggaaaaggggacaggaacaaaggaccaaaaataagctacatgttttatttcttcatcgtgttcaccactgtatgccaaggcttttcagttctgtggctgtttagactgtccgtaatggaatggtaaaactccatgaatttgcactttggtttttgatacctgtggagctgtctgtaggttgggaagtggcatgaaaattttcttaagctaaaatacagacatgtttcaaagggctaaagttggagatgagtagatagggtgaaaaatgggttaaatttgctagcttaattgttttaagaagaaaacagtgtctcataaattgactatcctggcatcacatttaacatgttatctacttagaaagcatttgtagagctgctgaatttgttttgtgtttttctgtaataatttaatgttacttattatcagaatttctgaaacctttacaaaaattctgatttattccattaatggccggttaaacacgtgggcatttattgttttattgaggaatttgacttaaactgggaatcctgtcatgttgtttatctttccagcttgcctgtttttgagtatgtttgatgtttttaaaattttgtcttctctgtggaagacaggaggctacagcaattaactttaagcctccttttagagatatttttaaaacttgtttaaaatttttgtgcaattcatatattaaattgcacttacttgcatacgctcatattctagggttttttctctatttttagggtatcatagtaaatcattagtaaatgagtctgtagttactaaaccctaatggaataattattaatgaaagatttttgaaatataaaaaataaattaggcccaatccaagaaattgagtgagaaggaaacacttgttttattcacagaggtaaagtgtcttttcaatataaccagcaatttaggtggcatctataaaataaaaaatttctactgtggacatccccttttccaactttctacataatggctagttctgactactaagaaatgttaagaaataggccaagtgcggtggctcacgcctataatcctatcactttgggaggcctaggcaggcagatcacctgaggtcaggagttcaagaccagcctggccaacatgacgaaaccccatctctactaaaaagacaaaaaattagctgggcatggtggcatatacctgtaaccccaactacttgggtggctgaggcaggagaattgtttgaacctgggaggcggaggctgcagtgagctgggattacaccattgcattccagcctgggcaacagagcaagactgtctcaaaaaacaaaacgaaacaaaaaaagaaagttattcttagtaaggaacttcttgtttaatagcatttttgtttattttaaaaagtgatcagaagtagtaaactatctttgaggaaatactgtaaccccagaatatttcctcttgacttctttttgtaacaaggataatttagggatttataaagttgtaaggatttcactgtttttggactgcctataataatagcacattaaccttcacataataagaaatctggacaagttcagttacacagtatgatgaatacttgaattaggaacattgtggaaaatttgctttagagaatcaaggcagtagtttggtatttggtgcttattaaaaatgtggtttgttttgaactggaagcaagttgaccaaggacttatgactaatgtgatgctaagttccacttggccccttttaaaaacgtgtatgtgccttttgaagatacacaaaacactgaggattttagttttgaaatcaaagactattaaaggagctgtacagaggtaaaaaaataaatgtggaacattattaacttactttgtgtctaggaacaatggattttgtatctgatttaaaatgccaacactgttttgtctctgttcattttttctgtgaggatacttaaggttattattcctgtctgtttcctgtactcccctagtcatgagcacttgaagtacaaggtgtctccccctaggtgcaattaggttgtttctttgtttttagtttcaattctatgtgcatagcaggaatgctccacaggaatggcttctgacaataatctgtcctgttgattttgttttccttgcccatgacttgaacaactgtgttttaaagtactgtagtctagtaggtaactttgtggcaaaaattttcaatataatacattctgaaacaatagttgctgccttgcaaaggtaatctctcattttaaaattggacagtattaatgaaggggaaatatacaatttatttctattgagtggtagaactatatgtctggtcccttgctgctcttgtttaggccactatcatagatatatttcaaatattgtactactcagtgttaagtattgaatgactgtttccctttccttcaaggcctagagtatattctgaaaatttaggaatgaggaagaaatcttaatacttccttccttaacatacaacatgagtcccgagaataattgatagtagcaagagaaaactatgtcagtaacatgttgctttgtataaaaatcttatttataaatgtgaagctttttgatgccatcaaaacttattaaaaaataggatttacttttttctaattctgacctaagaaaaataatgagaacaagctgttgcaagctcttttgtagtctattgaatattttatagatattcaaaatttcctacaaactataattttttccatgatttagcagtgagtgattttctagctttggctcttattaggtattgtaaatagtagggttatatcgatatcagcttttgtgatggcattgtggtcatcagcttcatgacattttacccatttgcagtgatcctgtgtaaaactgccaaggaaagtaattacctgtaggagtttgctgagcttgaagagtgaaaactgttgtgaatgagcctgatcataaaacggaccaggccattcattattcctcaagtgttaatatactgacttatgcagtattcaaaccatctagtgcaatgtttttgtttttgttttttttttggtaacacaggtgcagtgtattatagaaaaaataaaaactacaatcattagcagttttaatactgctgtgtcagttttgtaaaaaatgtacattatgtcttttgacatgttgaattttaaactagggaaatgacattgtaaatcatagtagcctcttttaatttaatatgaaaaatgccactatattgaaagtacttaatgtattgtatatatttctctactttggttctagctattttatatgattgacatgttatttaaaagataactgccttgaacttttggagacttgtactgtaaataaagaaatcttaacaataaactcagaatctacttactcca

SEQ ID NO: 22410 - DNA, 830 bp, Homo sapiens
acatccctagagctcagggatttttaaaggccctgctctgagaggtggggctgttcccgctatttatagggactgggagattcctgttcccagctctgagttcctcacacccagctgggcctgctcactgagtcagggcaccctggtaggtggtcacctctgtcactccttctctctcctgcctcccctactccctcacccttccccatcccctgcatgtcatcagagttctgagacagagctcagcccagaatctccttgaagaagcggacacaaagcaaaaagctcttgccagttctgagtggggaaatgcggccttggtcctccccggctcagcttgttgcaggggctcagcctgctgggaggggggaccccttgggccctcggcctataccaccgccccgctttcgtcgggcttccagccagagggaacctccttatcccaggccagcggagccagctctggaactggctggctccaaatgccagcctgatacccctgctgccagcctctgcccggcagactcccccagccagcatcgggtgatgccaccagggcctgccagctgggcaaacgtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaa

SEQ ID NO: 22411 - DNA, 7686 bp, Homo sapiens
aaatttacttccccaaaacactgggacattgggatggaattcactcaccccaaatcatcaccctggttaaggagactaaagaatcagaagacatttgtgctttggggagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccgggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggaggtgagctcgctccccctggtgctcgccagcgcccccagctgggagtgggcttgcctgcctgacatctatgttctcctgaagcagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttgagaaaaaaatgaaa

SEQ ID NO: 22412 - DNA, 2375 bp, Homo sapiens
atgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactagggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccagatgaacggaccataaatgtgttactggctttgtgcctgtagctcattttattatgacctatatgctcctgatttaaagagatctgtgtactgtttacttcccacttcccagaatcccttgtatctcctttctcgggaattgtattttctaataaatgacatttg

SEQ ID NO: 22413 - DNA, 846 bp, Homo sapiens
agtgcgccgggtgtccgggagatggcttcccctctctcgcccgctgctgccgctattgtctcacccggggtggcctgactctgcgagctcgcgcacgctctcggcggagagcacccctccccacccccacaagctggtccttgcgccctttgctgcctctccctctgccccttggagcctagggtctgtgcggagcctggagaggggagcggcccgggagcaggcggcgtgcggccggccagctcctctcgcgctggtgcaagaggcgcctggagccgcagagcgagcccgggaggcgcggagcgagcagcccacgtcgccaggcacaagacacgtcggatgttgcagcagagccagcagctagcgcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacattttt

SEQ ID NO: 22414 - DNA, 7318 bp, Homo sapiens
gagcagaggccctcagggtatagagaaggaagaagagagaggttcactgtagtcctgaagcagaaataagacctgtggctgaaggaagccttagcaattcactccttcctcttcctgagaactctctgtaggaagtctcacctagcagaggcttcacagtatttcagagaagccaaagattgtttgcctctttggaaactgttatccttccatcatgactgtgtcactcctgccactgttccaccatagagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctgggatgagcctggggtagacttttacagcaagccagcaggaaggcggaccgacctcaagctgttacgcggtctctctggctctgatcctacccttaactacaactcactctccccacaggaagggccgcccaaccactctacctcccaagggccacagcctggctcagatccctggcccaaaggctccctgtctggagactatctctacatttttgatggttcagatgggggagtctcttcgtccccaggaccaggggacatagagggctcttgcaagaaactatccccacctcctctgcctccccgagcttctatctgggatacccctcccctgcctcccagaaaggggtccccctcatcctccaagatctcccagcccagtgacatcaacactttctctttggtcgaacaattgccgggcaaactgctagagcatcggatcctagaagaggaagaggtgctgggaggtgggggtcaggggcgcctactggggtctgtggactatgatggtatcaatgatgcaattactaggctcaacttgaaatcgacctatgatgcggagatgttgcgggatgccaccaggggctggaaggagggccgagggccgctggacttcagcaaagacacctctggaaaacccgtggccaggagcaagactatgccccctcaggtgcccccccgcacctatgcctcccgctatggcaaccgaaagaatgcgacgcctggcaagaaccgccggatttctgcagccccggtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaagagctcacttctccaagtacctcttccacctcatcgtctgggaccagcagatctgcttcccagtgcaggtgaaccggctgcctcgggagacactgctgtgtgccactctctatgctctgcccatccccccaccggggagctcctcagaggccaataagcagcggcgggtgcctgaagccctgggctgggtcactaccccactcttcaacttcaggcaggtcctgacctgtggccggaagcttctgggtttgtggccagcaacacaggaaaatcccagcgcccgttggagtgcacctaatttccaccagccagacagtgtcatcctgcagattgacttccccacctcggcctttgacatcaagttcaccagcccccctggagacaagttcagcccccgctatgagtttggcagcctccgggaagaagaccagcgcaagcttaaagacatcatgcagaaagagtccttgtactggctcactgatgctgacaagaagcgcctgtgggagaagcgatattactgccactcggagtggacccacatgaaccaccaggatgccctggggctcctgcatgccaccttcccggaccaggaggtgcgtcgtatggctgtgcagtggattggctcactctcagatgctgagctgctagactacctgccccagctggtacaggccctgaagtatgaatgctacctggacagcccgttggtgcgcttcctcctgaaacgagctgtgtctgacttgagagtgactcactacttcttctggttactgaaggacggcctcaaggactctcagttcagcatccgctaccagtatctgctggcagccttactgtgctgctgtggcaaggggctgagagaagagtttaaccgccagtgctggcttgtcaatgccctggccaaactggcccagcaggtccgggaggcagccccatctgcaaggcagggaatcctccgcacgggcctggaggaggtgaagcagttctttgccctcaatggctcgtgccgcttgccactcagccccagtctgctggttaagggaattgtgcccagggactgttcctacttcaactccaatgctgtccccctcaaactctccttccaaaatgtggatcccctgggtgagaacatccgtgtcatcttcaagtgtggggacgaccttcgccaggacatgctaacgctgcagatgattcgcatcatgagcaagatctgggtccaggaggggctggacatgcgcatggtcatcttccgctgcttctccaccggccggggcagagggatggtggagatgatccctaatgctgagaccctgcgtaagatccaggtggagcatggggtgaccggctcgttcaaggaccggcccctggcagactggctgcagaaacacaaccctggggaggacgagtatgagaaggctgtggagaactttatctactcctgcgctggctgctgcgtggccacgtacgtcttgggcatctgtgaccgacataatgacaacatcatgctgaagaccactggtcacatgttccacattgattttggccgcttcctgggccatgcccagatgtttggcaacatcaagcgggaccgtgccccctttgtcttcacctcggacatggcgtatgtcatcaacgggggtgacaagccttccagccgcttccatgattttgttgacctttgctgccaagcctacaacctcattcgcaagcacacccacctcttcctcaaccttctgggcctgatgttgtcctgtgggatccctgaactctcagacctggaggacctcaagtatgtgtacgatgccctgaggcctcaggatacagaggccaatgccactacctacttcactaggttgattgagtccagcctgggcagtgtagccacaaagctcaattttttcatccataatctggctcagatgaagttcacgggctcagatgaccggctgaccctctcctttgcctcccgaacacacactctcaagagctctggccgaatcagtgatgttttcctctgccgccatgagaagatcttccaccccaacaaaggctatatatatgtggtaaaggtgatgcgagagaacactcacgaggccacctacatccagcggacctttgaggagttccaggaattacacaataagttgcggctgctcttcccttcttcccacttgcccagcttccctagtcgcttcgtgatcggccgctcccggggagaggcggtggccgagcggcggagggaggagctaaacggttacatctggcacttgatccacgcaccccctgaggtggccgagtgtgatttggtgtacaccttcttccacccactgccccgggatgagaaggctatgggcaccagcccagctcctaagtcctcagatggcacatgggcccggcccgtcggaaaggtgggaggggaggtgaagctgtccatctcctacaaaaacaataaactcttcatcatggtgatgcatattcggggcttgcaactgctccaggatggaaatgaccctgacccctatgtgaaaatttacctccttcctgaccctcagaaaaccactaagaggaaaaccaaagtggcccggaaaacctgcaatcctacctacaatgagatgttggtatatgatgggatccccaagggtgacctgcagcagcgggagctccagctgagcgtgctgagtgagcagggattctgggagaacgtcctcctcggtgaggtgaacatccgcctgcgagagctggacctggctcaggagaagaccggctggttcgccctgggatctcgaagtcatggcaccttgtgagcccagcagagccaccacccagcatcccaggctggtggcaggagctgggggagaggactctcccctgtgagactcctccttgtgaagggccagggccctgggcaggcctccagctcggtccaggtgattctggcctctgtggtaggaggcagggagagtaagacatgctctgctgtctcttcctctggagactgaacttgggttggttgtgatgagcagccccttggaggctgtgaggttgcagcaaagttttaagtttaccttgtgtcaagggagcaatgcttggtttggggagtgtgtggggtgggctgtatgaagtagcattttgggggtgggtgggtggatatcttaatttttatttttaaaaaatgaaatagtgatgttgtcctaactgggacaggaagccttgcgagaagggacgtacctatgccccagaaggcaagagaggaagactatttggactttttgtatgattaaggttcttattggacttttccctaggttttttttttttgttattgttgttgttgtttcgttttctagctataggaactatctggggaggggcccagtgggtcctcggccagagccctctctaaggacaggttggggagggttggggagggctgcctgtgctggactgaggcttgtgccactgggcctttctgattttgcctccaaaggagagcgctgtgatacctacatgtgtaaggaagggccttccgtattggggttctgccaaggacccgtattcagggacccatgctcttttggggggacttttcctcttgtcttccctactttattaggacttgccctgaataccattttctaccccttgcccctccattctcctggcccttctgggggtcagctggtctctatgaatatgctgggggtgcttccccataggtctctcccttcatttgtctctggtgggacaaaatactgactcagtccttagatgtagtttcacccaagagcatcttggccctgggaagaggtccctaggctgcagatgctactgactgcttgctaggtagcctctggaaagcattccccatccatcactccccacttctttctgctgtgctgcttccctcccaaactccatttctgtcaccctttttataagacttttcctcattctgtggggccataaacctatttagtctggagccaaagggatgccctatctgaaggaaaggggcatggggtgggggattccatcaaaactgttgttttttgccccatgatttttctttggtcagtaggaggctggattggagtggtgattattcccctggagctaagctcaggagcccgaagggagagactgagactgactcccttatctcttcatattctttattccctaccagatggatttttttttttttttttggagacggagtctcgccctgtcgccaggctggagtgtagtggcatgatctcgactcactgcaaaatctgcctcccgggttcaagcgattctcctacctcagcctcccgagtagctgggattacaggcatgtgccaccacgccaagctaatttttgtatttttagtagagacggggtttcaccatgttggccaggatggtctcgatctcttgacctcgtgatctgcctgccttggcctcccaaagtgctgggattacaggcgtgagccaccatgccccgccccagatggattttacatttgctcttttgtgtttcgctccaaagggttgtcttcctcgccaaaaggagggagggactttgaatttgatatgaatctttaaaaccagaattggctggatatttcccatgattgggaaaagagtgaaatgaggacattctgtaaactgtccctccctaattccaaggatcagaaactccccgttttgctgactcattccataactggagaaagaagctccattgaccgaagccacagggcagcatggaagtttaaattttctctaaaattaaaatgccaaggataaagctggctgcttccaggagggggaagaggagtggggagtgggcggtgaaacttttccag

SEQ ID NO: 22415 - DNA, 727 bp, Homo sapiens
ggcttcccctctctcgcccgctgctgccgctattgtctcacccggggtggcctgactctgcgagctcgcgcacgctctcggcggagagcacccctccccacccccacaagctggtccttgcgccctttgctgcctctccctctgccccttggagcctagggtctgtgcggagcctggagaggggagcggcccgggagcaggcggcgtgcggccggccagctcctctcgcgctggtgcaagaggcgcctggagccgcagagcgagcccgggaggcgcggagcgagcagcccacgtcgccaggcacaagacacgtcggatgttgcagcagagccagcagctagcgcagatggcgtcctttgcagcaaaccgtaagttataaggatgagggaagaagagtagagggccaaaaggattccattttgaggaaaaactacagtttgccttgccaggtagaagaatcaggcgcccagacaccatgtcacaaccctccagaactgacgttggcaggaagtagagactttgttgcctgtgtcccccatcctcaccatgtcttcgactcagggcaatggggaacactggaagtccctggagtcagtgggcatcagccgcaaagagctagcgatggccgaagccctgcagatggagtatgatgccctgtcccggctccggcatgacaaggaggagaacagagccaagcagaacgcagacccctctctcatcagctggg

SEQ ID NO: 22416 - DNA, 1659 bp, Homo sapiens
atgcggccttggtcctccccggctcagcttgttgcaggggctcagcctgctgggaggggggaccccttgggccctcggcctataccaccgccccgctttcgtcgggcttccagccagagggaacctccttatcccaggccagcggagccagctctggaactggctggctccaaatgccagcctgatacccctgctgccagcctctgcccggcagactcccccagccagcatcgggtgatgccaccagggcctgccagctgggcaaacgtgggctcccggccccacactgttgccaatggccatgagttgtttgaggtctcagaagagagagatgaggaggttgctgcattttgccacatgctggatatccttcgatctggctctgacatccaagactacttcctcactggctatgtctggagtgctgtcacccctagcccagagcacctcggggatgaggtcaacctgaaggtgactgtgttgtgtgacaggcttcaagaggcactcactttcacctgcaactgttcctccactgtagacttgcttatctaccagaccctgtgctacacccatgatgacctgaggaatgtggacgtgggtgactttgtgctaaagccctgcgggctggaggagttcctgcagaacaagcatgccttgggcagtcatgagtacatccaatactgccgcaagtttgacattgacattcggctacagctgatggagcagaaggttgtgcgcagtgacctggcccggacggtgaatgatgaccagagcccctccaccttgaactacctcgtccatctccaagagaggcctgtcaagcagaccatcagcaggcaggccctgagtcttctgttcgacacttaccacaatgaggtggatgccttcctgctggctgatgtaggaaaccatcaggaggtagaaggtttcacatgtagggagggccagagccctccccacttggattcatgcggagtctcaagcctcaaaaccatgagagtcaacatttgtcttaaatgtcacaacgccaaagaaaatctgacagtgatcttcaaaaataatcccttgctgagtgtgatggcccacgcctgtaatcctaaccctttgggaaactgaggtgggagaattgcttgaaccccaaagttcaaggccagcctgggcaacacagcaagaccccatctctacaaaaaatacaaaagttagccagggagacttcccactgaaggctgacagggtggtccagtccgtcaaggccatctgcaacgccctggccgccgtggaaacccctgagatcaccagtgctctcaaccagctgcccccctgcccctcccgcatgcagcctaaaattcagaaggatcccagtgtcttggctgtgagggaaaaccgagagaaggtcgtggaagccctgaccgctgccatcttggacctggtggagctgtactgcaacacattcaacgcagacttccagacggcagtgcccgggagccgcaagcatgacctggtccaggaggcctgccatttcgccaggtccctggccttcactgtctatgccacccaccgcatccccatcatctgggctaccagctatgaagatttctacctctcctgctccctcagccatggcggcaaggagctgtgcagccccctgcagacccgaag

SEQ ID NO: 22417 - DNA, 4754 bp, Homo sapiens
ggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacaggatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatccgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaaggattggtgcagatggtacctgatgctgtgaccctagcaaagattcatcgccattctggactgataggaccattgaaagaaaatacaattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaagaatcatcacctgtgtacctaggtgagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttctgggcctctgaatcacataagtaaggcatctttgttgtcaaagacagcacagggtattaaggacacagaaaaaaaatcagaattagtcttttgtgttgtttattttctacctgtgctttcattgttttttcataatcttttctccttcagtggagtactgattgcatgaaatttgatgtgtaaaataataaaagacctttattaaatcattttaatatattttaaattaaacataggtttacatttgttttaattgtgtgcctacagttaaaagcagtatttttaatgtattttataagaaagacaatcaaataaacctcatca

SEQ ID NO: 22418 - DNA, 4840 bp, Homo sapiens
tgagatcgtgtttcatttcaggaagatatatgcgtcaggaaaatttctatcttcttttgtattatcaaggagatatttggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacaggatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatccgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaaggattggtgcagatggtacctgatgctgtgaccctagcaaagattcatcgccattctggactgataggaccattgaaagaaaatacaattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaagaatcatcacctgtgtacctaggtgagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttctgggcctctgaatcacataagtaaggcatctttgttgtcaaagacagcacagggtattaaggacacagaaaaaaaatcagaattagtcttttgtgttgtttattttctacctgtgctttcattgttttttcataatcttttctccttcagtggagtactgattgcatgaaatttgatgtgtaaaataataaaagacctttattaaatcattttaatatattttaaattaaacataggtttacatttgttttaattgtgtgcctacagttaaaagcagtatttttaatgtattttataagaaagacaatcaaataaacctcatcaattaattc

SEQ ID NO: 22419 - DNA, 4566 bp, Homo sapiens
ggagcagagtcaaccctctcagttacataaaataaaaaatggcatattcttggcaaacggatccaaatcctaatgaatcacacgaaaagcagtatgaacaccaagaatttctctttgtaaatcaaccccattcttctagccaagtcagtctgggttttgatcagatagtagatgagatcagtggcaaaattccacactacgagagtgaaattgatgaaaacaccttttttgtgcccactgcaccaaaatgggactcaacagggcattcattaaatgaagcacaccaaatatccttgaatgaattcacttctaaaagccgtgaactctcctggcatcaagttagcaaagcaccagcaattggttttagtccttctgtgttaccaaaacctcaaaatacgaataaagaatgctcctggggaagccccataggaaaacatcatggtgctgatgattccagattcagtattttagctccatcattcacaagtttggataaaattaatctagagaaagaattagaaaatgaaaatcataactaccatataggatttgaaagtagcattcctccaacaaattcatccttctcaagtgacttcatgccgaaagaagagaataaaaggagtggacatgtgaacattgtggaaccatctttgatgcttttgaaaggctctcttcaacccggaatgtgggaaagtacatggcagaagaatatagagtcaataggttgttccattcagctagtggaagtacctcaaagcagcaatacgagtctggcctctttttgcaacaaagtaaaaaaaatcagagaaagatatcatgcagctgatgttaatttcaattctgggaagatctggagcactactacagcatttccgtatcagctcttttctaagaccaagtttaatatacatatttttattgataactcaacacaacctcttcattttatgccatgtgctaattatcttgtcaaagatctaattgcagaaattctgcatttttgcacaaatgaccagctactccccaaagatcatattctaagtgtatgtggctctgaagaatttttacaaaacgaccactgtttggggagccacaaaatgtttcaaaaagataaatctgttattcagctccacctgcagaaaagtagggaagctccaggaaagctatctcgaaagcatgaagaggaccacagtcagttttatctgaatcaacttctagaatttatgcatatttggaaagtatccagacaatgtctcttaacactcatcagaaaatatgacttccacctgaaatacctattgaaaacccaggaaaacgtgtataatattattgaagaagttaaaaaaatatgcagtgttctagggtgtgtggaaaccaaacaaattacagatgcagtaaatgaactaagtctaattcttcagagaaaaggagagaatttttatcaaagttcagagacttcagcaaaaggcttgatagagaaggtaacaactgaactatccacatccatctaccagctaatcaatgtctactgtaacagcttttatgcagattttcagcctgtaaatgtacctagatgcacttcctatctaaatcccgggcttccttcccacctcagcttcacagtgtatgcagcacacaacattccagaaacctgggtgcacagctacaaagcgttttcttttacctgttggcttacatatgctggaaagaagctgtgccaagtgagaaactacagaaatattccagacaagaaattattttttttcttggtcaactggaatgaaacgatcaattttccccttgaaataaagtcacttccaagggaatccatgctcactgtaaaactgtttgggattgcctgtgcaaccaacaatgcaaatttactggcgtggacttgtcttccactgtttccaaaagaaaaatccattctcgggtctatgctgttcagcatgacattacagagtgagcctcccgtagaaatgataactccaggagtgtgggatgtaagtcagccatccccggtgaccctgcagattgattttccagctactgggtgggagtatatgaaacctgattctgaagagaatagaagtaatcttgaagagccactaaaggagtgtataaaacatattgccagactttcacagaaacagactcccctactactctctgaagaaaagaaaagatatttatggttttatcgcttctactgcaataatgaaaactgctcccttcctttagtcctgggtagtgcccctggatgggatgaaaggactgtttcagaaatgcataccattttgagaagatggacattttctcaacctttagaggctcttgggcttttgacttccagttttccagatcaagaaattcgtaaagtggcagttcaacaattagacaacctcttgaatgatgaactactggaatatctcccacagctagttcaggctgtcaagtttgaatggaaccttgagagtcctttagtgcaacttctactccaccgctccttgcagagcatccaggttgcccatcgtctttactggctgctaaaaaatgcagaaaatgaagcttattttaaaagctggtatcagaagctactagctgctctccaattctgtgcaggtaaagccttgaatgatgagttttccaaggagcagaaacttatcaaaattctgggagatattggggaaagagtcaagtctgccagtgaccatcaaagacaggaggtactgaagaaagaaattggcagactagaagagttctttcaagatgtaaatacttgtcatcttcctctgaaccctgccctatgtataaaagggattgatcacgatgcatgttcatattttacatctaatgctttgccattgaagattactttcatcaatgctaatccgatgggcaaaaacatcagcattatttttaaggctggagatgatcttcgtcaggatatgcttgttctgcagcttattcaagtgatggacaatatttggctgcaggaaggcttggatatgcaaatgatcatttatagatgtctatccacaggaaaagaccaaggattggtgcagatggtacctgatgctgtgaccctagcaaagattcatcgccattctggactgataggaccattgaaagaaaatacaattaaaaagtggttcagtcagcacaaccacttaaaggcagattatgaaaaggccttgaggaactttttctactcctgtgctggctggtgtgtggtaacattcatcctgggagtatgtgaccgtcacaatgataatatcatgctgacaaagtcgggccacatgtttcatattgactttggaaaattcttaggtcatgcacaaacatttggagggataaaaagggaccgagctcctttcatttttacttcagagatggaatactttattacagagggtgggaaaaacccacagcattttcaagattttgtggaactttgctgtcgtgcttataatattatcagaaagcacagccaactgctcttgaacctgctggaaatgatgctgtatgcaggactgcctgagctaagtggaattcaagacctgaaatatgtgtataataatcttcgtccacaagacacagacctggaagcaacaagtcattttaccaagaaaataaaggaaagtctggagtgtttccctgttaaattgaataacttgatccacacacttgcacaaatgtcagccataagccctgccaaatctacttcacagacttttcctcaggaatcctgtttgctgagtacaactaggtcgattgaaagagcaacaattttagggttcagcaagaaatccagtaatctgtatctgatccaggtgacacacagcaacaacgaaacaagcctgacagaaaaatcatttgagcagttttcaaaacttcacagccaacttcagaagcagtttgcatcactgactctcccagagtttcctcattggtggcacctaccttttacaaattcagatcacagaagattcagagatctaaatcattacatggaacagatattaaatgtatcacatgaagttacaaacagtgattgtgtacttagctttttcctctctgaggctgtgcaacaaacagttgaagaatcatcacctgtgtacctaggtgagaagtttccagacaagaagcctaaggtgcagttagtcatatcctacgaggatgtgaagctgaccatactagtgaaacacatgaaaaacattcatctcccagatggctctgcgcccagtgcacatgttgaattttatcttttaccatatcccagtgaagttcgtaggaggaaaacaaaatctgttccaaaatgtacggaccccacttacaatgaaattgtagtatatgatgaagtcacagagctccaaggacatgtcttaatgcttattgtgaagagtaaaactgtatttgtgggagcaattaacatccgactctgtagtgtcccactcgataaagaaaaatggtatccattaggaaacagtataatttgaccattgctatgaacatatgcattattcattaactacttgtatttttttcacttctgggcctctgaat

SEQ ID NO: 22420 - DNA, 3466 bp, Homo sapiens
agttgctgggattcacaacacactgacttctggacgtggtcagggtggctttctctggctggcatggacttgagcagaaactcattgccggcttcctccttgcacgagcaccaagtgattcccaggtcccccatcctcccctgggacatcgaggacacacaaaaaccttgttcaccctccactgagagcggggctagagatggatgctgagtacaggaagggtgtgtgaggattcctttggctccactcttgtttccaactattgctggtcctaggcgcccagtcctgagcaaccatgacgatggagactctccccaaggttctagaggtcgatgagaagtctccagaagccaaggacctgctgcccagccagaccgccagctccctgtgcatcagctccaggagcgagtctgtctggaccaccacccccaggagtaactgggaaatctaccgcaagcccatcgttatcatgtcagtgggcggtgccatcctgcttttcggcgtggtcatcacctgcttggcctacaccttgaagctgagtgacaagagtctctccatcctcaaaatggtagggcctggcttcctgtccctgggactcatgatgctggtgtgcgggctggtgtgggtgcccatcatcaaaaagaaacagaagcacagacagaagtcgaatttcttacgcagcctcaagtccttcttcctgactcgctgatggtggtttccgcatctccctgccaccttgactgggagaagatctgatgaccaacatccgacatccctgtctcctctgtggggtgccataaaactgatccaggaaaatgctcttcctgaccctgtggggaagatagagcttggggctccaccctccatgcagccgggaatgttgccagatgtatccacttgatctctattctgactgatgcttccttggatcccggctgtggccttccctttggtcactctaaccccctgcccctgcatccaggcatcattcatccaactctctctgccaagtgcaatgcatgctgggaaattcttcgaaggtgggctatgcccaagggagaacctcatgtttacatatctgagtgccagagctggattcttcatttgcatacttctggaaccaaaactgacccacggaggtcctttacagaggagggagggatggctgagctctgacccattgggtttgacagccctagctcccttagcagactttcaagatcacaagtatcaaacattccaaagactgaacaatgaagggaggcctgggaaaaatactctccaagatggcacgtgcccctggacatgacaacatgactctaggggttagtcagctgaagaagtttagttcctaattatataatatttacatcagaggcagtggggtaggctaggggatgtcactgtttccgcttgaccttatctttctcattgaccactgtcttctctgaacttgatcattagccaaggacaaaatgcatgttgccctaatttctttcctacccctgcctctatctctgcatctagaacagctaaatggaaagatacagagggatcctgtaaggttgttttccctttcacgtccatcaagatcaaaattgagagaatcaagttccatatctgaatgatctgtaggtttctagagatggaattcacgtcagaaaattccaacttctgttatccctgcccccacccaccaaaaaagccaacatttattaagtgtcgcattctgggataagccctggctgggggcaagacacggtccctgatgtcttcttgcttcccgaggtgagagaggcagccaagccaactggcgaaatgtgggtgggtgtgggaacacaggcggtgtctaccctagacttgatagaggacggagaaattcctggaggccatgtcctccaacccaaaaacaaaaggaaagataagagttaccaaagaggggaaagaatggcattggaagcagcaggagctgctatgcgtgtgcaggagtagcttggggaaggagaagcatgatggaattaggaaactgcacggccatttgtctgacctcccagatgtttttacttcatccctctctttcccggcttcccacctcttcaccaagtgcctagcgcagcttctcctggaggcacattgagggcctcctggtgtctatggtagagacgggaagtgggtttccagagggcctggcaagcaaagagtccctgagaagtgcttctgtaactccctgtggcaaccaagaggcccgtaggtgaaagaacagaagcagtacctgtgagggagccagccacgctgccctaggccaaagacccctggagagcatttggtaatgaggtgtgagaggagagcatcctgcaccagaatcacccttgtcttgagctaattctcttcactcctcagccttgtggccttcccagtcaccatggccctccagatatccccatcctgcatggcagttccatatgcagagccagaatccatccttgttccttctgcattgtgagaaaatccatggaggaaagcacttgtgtcatggggaccacccctacctgacccacccacggagtcagagtttggggaactcatggccgttgaggctcacccaggatggccatagccttcatggagacccatgccagtgtggccatgtctctagctcacctctagccctgcacacaggtggtcaggaccaatcttgggagtgttgcaagtgctatgtcgttaattgtagttttagtgcctcagtgacaaaccttgcagatcatttcccttcttctgagatgaatgcagatttgatggccctataatattactcttgcattcctcgatgcattcttaaatgggagcaaatgggatgggccccagatcactcactggaaacccacactccaggtgcctcatttcctctgcccaggagattgtagcctgggcacagctatatgaggagggcccatttggatactgctatcatggatgtcttagtggaaggaagtttagggataaccacaactctagaagtccaggttctggactcactttgcagactctagcagtacctgcctccattccctgcccactcaagctagtttctcagcaaagagaatatgaggaaatatccccaaacatcgtcatccccactgggatcctccacatgagtgtgggctggaaaggttccagggtcacactgaggcaggacattttttgccaatgcctgttaccccatggaaggctgaggtacggatgcacctgatctggaaatgcagcccaggtcagactccacatttctgcaacaaagcatcacctgcaatgactcttttcacgtcagtgggtcaaaggacagaaccagcttccgtgttttaggctcactagattgtctcatgctccccatggctattctgtttgggagaatttgatctaacccgaagcctaaaggaatcaatgtaatgttgaattgtattctatgtaa

SEQ ID NO: 22421 - DNA, 1794 bp, Homo sapiens
agtgtagcctgagtcagccggagggtctgatccactctttggcaactcatccccaccaccatggccactacacacctccaccaacccagaaactccaggtcctctgatttctgagcctgggtcaggagaagctgccctgcccaggcaccaacggaacgcacgcctccatgaaacttgaagacagactgcagagaagcatcatgaatttttcacaagattcatctaattgtggctgagcagagctgagaaagccacagtccgaggacccatgccagcagctcacaaagagttaacccattaggccattgcctggtgagctcatccatccctgctggagcctgctcagttgctgggattcacaacacactgacttctggacgtggtcagggtggctttctctggctggcatggacttgagcagaaactcattgccggcttcctccttgcacgagcaccaagtgattcccaggtcccccatcctcccctgggacatcgaggacacacaaaaaccttgttcaccctccactgagagcggggctagagatggatgctgagtacaggaagggtgtgtgaggattcctttggctccactcttgtttccaactattgctggtcctaggcgcccagtcctgagcaaccatgacgatggagactctccccaaggttctagaggtcgatgagaagtctccagaagccaaggacctgctgcccagccagaccgccagctccctgtgcatcagctccaggagcgagtctgtctggaccaccacccccaggagtaactgggaaatctaccgcaagcccatcgttatcatgtcagtgggcggtgccatcctgcttttcggcgtggtcatcacctgcttggcctacaccttgaagctgagtgacaagagtctctccatcctcaaaatggtagggcctggcttcctgtccctgggactcatgatgctggtgtgcgggctggtgtgggtgcccatcatcaaaaagaaacagaagcacagacagaagtcgaatttcttacgcagcctcaagtccttcttcctgactcgctgatggtggtttccgcatctccctgccaccttgactgggagaagatctgatgaccaacatccgacatccctgtctcctctgtggggtgccataaaactgatccaggaaaatgctcttcctgaccctgtggggaagatagagcttggggctccaccctccatgcagccgggaatgttgccagatgtatccacttgatctctattctgactgatgcttccttggatcccggctgtggccttccctttggtcactctaaccccctgcccctgcatccaggcatcattcatccaactctctctgccaagtgcaatgcatgctgggaaattcttcgaaggtgggctatgcccaagggagaacctcatgtttacatatctgagtgccagagctggattcttcatttgcatacttctggaaccaaaactgacccacggaggtcctttacagaggagggagggatggctgagctctgacccattgggtttgacagccctagctcccttagcagactttcaagatcacaagtatcaaacattccaaagactgaacaatgaagggaggcctgggaaaaatactctccaagatggcacgtgcccctggacatgacaacatgactctaggggttagtcagctgaagaagtttagttcctaattatataatatttacatcagaggcagtggggtaggctaggggatgtcactgtttccgcttgaccttatctttctcattgaccactgtcttctctg

SEQ ID NO: 22422 - DNA, 2001 bp, Homo sapiens
aaactgggtgacagagtcagaaaactccccagctaaacacccgtaagacttcatacaacacaatactctatactgtgatgatcacagctgccaaggctacctaaaagaagacagttatctcatatttggctgccagctttttatctttctctcgaccacttaaaacttcagacttcctgtcctgctggtatcatggagaaagtccaatacctcactcgctcagctataagaagagcctcaaccattgaaatgcctcaacaagcacgtcaaaagctacagaatctatttatcaatttctgtctcatcttaatatgtctcttgctgatctgtatcatcgtgatgcttctctgaagttctgctacaacctctagatctgcagcttgccacatcagcttaaaatctgtcatcccatgcagacaggaaaacaatattgtataacagaccacttcctgagtagaagagtttctttgtgaaaaggtcaagattaagactaaaacttattgttaccatatgtattcatctgttggatcttgtaaacatgaaaagggctttattttcaaaaattaacttcaaaataagtgtataaaatgcaactgttgatttcctcaacatggctcacaaatttctatcccaaatcttttctgaagatgaagagtttagttttaaaactgcactgccaacaagttcacttcatatataaagcattatttttactcttttgaggtgaatataatttatattacaatgtaaaagcttctttaatactaagtatttttcaggtcttcaccaagtatcaaagtaataacacaaatgaagtgtcattattcaaaatagtccactgactcctcacatctgttatcttattataaagaactatttgtagtaactatcagaatctacattctaaaacagaaattgtattttttctatgccacattaacatcttttaaagttgatgagaatcaagtatggaaaagtaaggccatactcttacataataaaattccttttaagtaattttttcaaagaatcacagaattctagtacatgtaggtaaatcataaatctgttctaagacatatgatcaacagatgagaactggtggttaatatgtgacagtgagattagtcatatcactaatatactaacaacagaatctaatcttcatttaaggcactgtagtgaattatctgagctagagttacctagcttaccatactatatctttggaatcatgaaaccttaagacttcagaatgattttgcaggttgtcttccattccagcctaacatccaatgcaggcaaggaaaataaaagatttccagtgacagaaaaatatattatctcaagtattttttaaaaatatatgaattctctctccaaatattaactaattattagattatattttgaaatgaacttgttggcccatctattacatctacagctgacccttgaacatgggggttaggggagctgacaattcgtgggtccgcaaaatcttaactacctaatagcctactattgaccataaaccttactgataacataaacagtaaattaacacatattttgcgtgttatatgtattatacactatattcctacaataaagtaagctagagaaaatgttatttagaaaatcataagaaagagaaaatatatttactattcattaaatggaagtgggtcaacataaaagtcttcattctcattgtcttcacattgagtaggcagaggaggagaaagatggggaggaagagaaggcgttggtcttgcagtcttgtcttaggggtgtggggagtgggggaaagaatattcatgtataagtggacccttgcaattcaagcccttgttgttcaagggtcaactgtaataggatatagctatttttcttcctctatcaaccaaatggtaagcatctattttgcagtccactctactgagctaaattatagatccagctatgctatttataattattttcttgatgaataaattt

SEQ ID NO: 22423 - DNA, 1786 bp, Homo sapiens
gaggctgggttatatgatctctttggctttagggaattactccataccagctctgagatttccagctcagcgatgcccccaggtccctgggagagctgcttctgggtggggggcctcattttgtggctcagcgttggaagttcaggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcagggttttaggaacaaagccttcctggattgacacatttattagaacccttctgcgtgcaacgaatgctaatgtgattgccgtggactggatttatgggtctacaggagtctacttctcagctgtgaaaaatgtgattaagttgagcctcgagatctcccttttcctcaataaactcctggtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaa

SEQ ID NO: 22424 - DNA, 1695 bp, Homo sapiens
ataccagctctgagatttccagctcagcgatgcccccaggtccctgggagagctgcttctgggtggggggcctcattttgtggctcagcgttggaagttcaggggatgcacctcctaccccacagccaaagtgcgctgacttccagagcgccaacctttttgaaggcaccgatctcaaagtccagtttctcctctttgtcccttcgaatcctagctgtgggcagctagtagaaggaagcagtgacctccaaaactctgggttcaatgccactctgggaaccaaactaattatccatggattcagggttttaggaacaaagccttcctggattgacacatttattagaacccttctgcgtgcaacgaatgctaatgtgattgccgtggactggatttatgggtctacaggagtctacttctcagctgtgaaaaatgtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcacttgctttatctccttgggcattcgtacttaggattcaatagaaacatgtacagggtaaacaattttttaaaaataaaacttcatggagtatctgaa

SEQ ID NO: 22425 - DNA, 1456 bp, Homo sapiens
gaattactccataccagctctgagatttccagctcagcgatgcccccaggtccctgggagagctgcttctgggtggggggcctcattttgtggctcagcgttggaagttcagggttttaggaacaaagccttcctggattgacacatttattagaacccttctgcgtgcaacgaatgctaatgtgattgccgtggactggatttatgggtctacaggagtctacttctcagctgtgaaaaatgtgattaagttgagcctcgagatctcccttttcctcaataaactcctggtgctgggtgtgtcggaatcctcaatccacatcattggtgttagcctgggggcccacgttgggggcatggtgggacagctcttcggaggccagctgggacagatcacaggcctggaccccgctggacctgagtacaccagggccagtgtggaagagcgcttggatgctggagatgccctcttcgtggaagccatccacacagacaccgacaatttgggtattcggattcccgttggacatgtggactacttcgtcaacggaggccaagaccaacctggctgccccaccttcttttacgcaggttatagttatctgatctgtgatcacatgagggctgtgcacctctacatcagcgccctggagaattcctgtccactgatggcctttccctgtgccagctacaaggccttccttgctggacgctgtctggattgctttaacccttttctgctttcctgcccaaggataggactggtggaacaaggtggtgtcaagatagagccgctccccaaggaagtgaaagtctacctcctgactacttccagtgctccgtactgcatgcatcacagcctcgtggagtttcacttgaaggaactgagaaacaaggacaccaacatcgaggttaccttccttagcagtaacatcacctcttcatctaagatcaccatacctaagcagcaacgctatgggaaaggaatcatagcccatgccaccccacaatgccagataaaccaagtgaaattcaagtttcagtcttccaaccgagtttggaaaaaagaccggactaccattattgggaagttctgcactgcccttttgcctgtcaatgacagagaaaagatggtctgcttacctgaaccagtgaacttacaagcaagtgtgactgtttcctgtgacctgaagatagcctgtgtgtagtttaacctgggcaggacacatctccctgcattttttttttttttttgagagagaggtgtgatgagggatgtgtgtgtgcagcttattgtagaccattactactaaggagaaaagcaaagctctttcttattttcctcataatcagctaccctggaggggagggagaactcattttacagaacttggtttcctttgccgatcttatgtacatacccattttagctttcccatgcatacttaactgcact

SEQ ID NO: 22426 - DNA, 2458 bp, Homo sapiens
agctgaaaaagctggagcaaccaagcagggcctacaagccgaggagggctgtttaaaggcgcaggggccattttacctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggaggactgagaattttctgaccgcagtgcaccatgggaagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatagatgagcctcagcttccagggcactgtgggcctgttggtctactagggccctgatgtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggatta

SEQ ID NO: 22427 - DNA, 8526 bp, Homo sapiens
cccgagtgtcggttcactgtggagacagcggtggcggagtgggtctccagggctctgggctggcaaggcccccggagggggtggggcgcggaggaggctacggatccgcttccgcgcggcggggccgggtgcttgggacgcggctctgggctcccgggataaggggctcccgggacaaggggctcccggagagcccagtggttagcgatgctgctgtcgccgtcgctgctgctgctgctgctgctgggggcgccgcggggctgcgccgagggtgtggcggcggcgcttacccccgagcggctcctggagtggcaggataaaggaatatttgttatccaaagtgagagtctcaagaaatgcattcaagcaggtaaatcggttctgaccctggagaactgcaagcaagcaaacaagcacatgctgtggaaatgggtttcaaaccatggcctctttaacataggaggcagtggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtggatgggcctcaatcagctggatgaacacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggagagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataaggcaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatcaaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacaatgaaaccataaagtggtttgatggaactcccacagaccagtcaaactggggcattcggaagccagacacagactacttcaagccccatcattgtgttgccttgaggatccctgaaggattatggcagctatccccgtgtcaagaaaaaaaaggctttatatgtaaaatggaggcagatattcacactgcagaggcgctgccagaaaaaggaccaagtcacagcatcattcctcttgcggttgtactgacactgatagtcattgtggccatttgcacactttccttctgcatatacaagcataacggtggcttcttcaggagacttgcagggtttcggaatccttactatcctgcaaccaactttagtacagtatatttagaagaaaatattctcatttctgatcttgagaagagtgaccaataataatgaggtcagagaatgccacagacaccagggtaagtaaagaagactaaacaggagtctcatctgtctttccctttacagcacagatgccattagaatgtgaattgggtcactattttaattattcttgaagtgattactggttttgaatcttaaccaaatcagatgggttttgatttattcatttccctaaactgtgatccattcttaaaaggggtaaattatgcattggttatttttcagaaagacaagaactattaaaagaaactccctattgaaaactctgaaatcaatgcgaataatagtttttgcattaatgtatctctactaaaatttgggggaattttaaaactaatctggtatctattcagacatttacctgcactcgtaccattaagaaagacagaaagaagcaaaaaaaaattaatcttgtatatgagaggaaaaggaaagggcttctgagaggattcttagttgtttcttttgaattcacttttaatagcaggatttggaaaatactaatttctgtgcttaagggtcacaggttctgggctctcaactgatatttaaggtgacattcatttttattaggtctaacatctcaagctaaaggagaaagaaaaataccttcttttaaatggcaaagaccttcattagcagcacacttttataaacaaccatatagttaaaatgtggccttaaactttcaattactaaatgatgattaagttggatattttaaaatgtcttatacataagcttaaagtaatatattgaaactttaacagttgtactgttaaaactcatggactttctgaaaaactaaatatataaaataatatgtaacactcttaataactggaagatataaaatgtaacttggatttaaaggagaagagctaaagatctgaattatagtctcattagaaccagacagatgttgttgagaagtactaaataaattagtaatctagatatctttattatgtaaatgagtttaggtgttctatttaataaactattttctgggaacgatctccttttatattagtctagttagtgtagatggtaaataatgattatgatactgtctgtaaataaaaaattacagattttattttcctttattagttccttataaagaaaacagcttcataatcaatatctaaaaatttactcattacataactgtttattgaattttatcaagaaaaaagtgtactgagcatggtggcacgcacctgtagtcccagctacttaggaggctgagggaagaggatcaactgagcccagaagttgaaggctgcagtgagctatggttgcaccactgcactcctgcctgggcaactgaatgagaccccacctcaaaaaagtgctgttctagaaacagaggtactaaggtgagcaacttggggtaagggctatcttttcatgccacttattttctaatgagggaaaattgacagtaactcagtaaagaaatgcatatgcataaaatagcaagtggttatgaaaatgaagtaaggttccatgatagagagaaactgggggactctcagggcctccctgagagtgtgcattttaattattacaaccaactgcctcaaaaccagtggccactaatcacaagggggagctctgagagaaagtatgaatgaatttctaagaggcaaaccatcatcattagaaatacaatttgaagagcataccactaagaatggaatccttgtggcctgcaacagttaatccagcttccaaaagcagctctttgctactgttataataatttacacactgggacagtctacctccataatttttttaagtattgggacttcattttttaaaagatattatattatgtggcagttgcatatttatgactcaaaaaataattggcttgaactcaccagatggtataaaagcccaatttaaccatcttttgagtggaattaaagttctgttcttttcaatggacttggtaaaaactgctaatcaaccagccttccagtcaaggtatatagtcacacataataatttgacaaaatacaccattaggaaagtgattttgcagaaagaagctgtattgcttctcagtgctccatactttgatgtttagtattgaacaacatctccagataatctggacccatggacagatcacacacttcttgccattactgaatttgcagaaatagtactgaagtattctgctacatttttatatttgcattttttttgaaactttttttcattttttttttttttttttggagatggagtcttgctctgttgccaggcaggagtacagtggcatgatctcagctcactgcaaccttcaactgcctggttcgagcaagtttcctgcctcagcctcccgagtagctgtgattacaggcacatgccaccatgcccagctaatttttgtatttttagtagagacagggtttcaccatgttgtccaggatggtctcgatctcctgatctcgtgatccacccgccccagcctcccaaagtgctaagattacaggcatgagccaccgcacctggcctcatctgtatttttaatgtgaactagattttatagctataattcgaaaagaaaaaaaagtagcaggtaatgggtatattatacactatttgcgtgatggttacaccagactttaccactacatactgtatttatgtaacaaaattacacttgtactccttacatttatgccaaaaaagcggcaggatcacaaattcacacatagttaatgtgcccctccaacagtcaattatgttctatgactaacctgaggatctttatagaatctgagtaatggaaatgcctgggtttttccatttaacaatatattgggctcttacagttacaacagtcttctttcgggttaaatatttcttctcttgaagggtccactccttattaaagataagattgaactgaatgtttacttaaacgttcagtcttttggagtttctttactcttctcaaaatggtggttggatatataagaacttgctgtgtcctggtagtgttgaggggagaaggtgacaacttactgtggatgtatgttagctggtgtccactgagaatagctgtctggcctcactcctgggaattctgctggcatctgctgtgaagtctgcagttgctttaatctgtagtctgttctctttgatttggcctcattctggctgtccctggtgctgtcttatctcttgagaactggctgtgtctcctgttgaattccctatccgaacactgcagttcttggctacaaggcagtcacttcacccctgcagtggtgagatcccattagctaccattagctactcttttcgtccagaaaggcgaaatgccatagcaaacaatcccacagtcttggtggattaacacagcaaaggtttatttctcacccacacctgcatgggctggcaagaggactttgctctgttcagtcattcatgggtccatgcttctcctatatagccagccctctgtctcctaaggcctggagtcctccatgggcctccaatctgtggctgacagaggatgttgacttgagacccatctttgattcattatggagcttccacaggctgttgaaatcctctaagtcaaaagtcctcaaactggggacacatgcctaaggaatacaggagcatgggtatttaagaaacttaatttccagaatcttcatgtatattttttcttaaaactgatttacctgagagcacccctggttcttctttcccacctctctttacacaaatgcctttctctacctttaaaaagaaaaagaaaaagaaatggctttcatttcagatcttactatgggaaaatcctccatggctccaaagaaaaatattcgaagtattgatgtcagtgaagcttcttttaataaagaaattgtaaactca

SEQ ID NO: 22428 - DNA, 5160 bp, Homo sapiens
cccgagtgtcggttcactgtggagacagcggtggcggagtgggtctccagggctctgggctggcaaggcccccggagggggtggggcgcggaggaggctacggatccgcttccgcgcggcggggccgggtgcttgggacgcggctctgggctcccgggataaggggctcccgggacaaggggctcccggagagcccagtggttagcgatgctgctgtcgccgtcgctgctgctgctgctgctgctgggggcgccgcggggctgcgccgagggtgtggcggcggcgcttacccccgagcggctcctggagtggcaggataaaggaatatttgttatccaaagtgagagtctcaagaaatgcattcaagcaggtaaatcggttctgaccctggagaactgcaagcaagcaaacaagcacatgctgtggaaatgggtttcaaaccatggcctctttaacataggaggcagtggttgcctgggcctgaatttctccgccccagagcagccattaagcttatatgaatgtgactccaccctcgtttccttacggtggcgctgtaacaggaagatgatcacaggcccgctgcagtactctgtccaggtggcgcatgacaacacagtggtggcctcacggaagtatattcataagtggatttcttatgggtcaggtggtggagacatttgtgaatatctacacaaagatttgcatacaatcaaagggaacacccacgggatgccgtgtatgtttcccttccagtataaccatcagtggcatcatgaatgtacccgtgaaggtcgggaagatgacttactgtggtgtgccacgacaagccgttatgaaagagatgaaaagtggggattttgccctgatcccacctctgcagaagtaggttgtgatactatttgggagaaggacctcaattcacacatttgctaccagttcaacctgctttcatctctctcttggagtgaggcacattcttcatgccagatgcaaggaggtacgctgttaagtattacagatgaaactgaagaaaatttcataagggagcacatgagcagtaaaacagtggaggtgtggatgggcctcaatcagctggatgaacacgctggctggcagtggtctgatggaacgccgctcaactatctgaattggagcccagaggtaaattttgagccatttgttgaagatcactgtggaacatttagttcatttatgccaagtgcctggaggagtcgggattgtgagtccaccttgccatatatatgtaaaaaatatctaaaccacattgatcatgaaatagttgaaaaagatgcgtggaaatattatgctacccactgtgagcctggctggaatccctacaatcgtaattgctacaaacttcagaaagaagaaaagacctggcatgaggctctgcgttcttgtcaggctgataacagtgcattaatagacataacctcattagcagaggtggagtttcttgtaaccctccttggagatgaaaatgcatcagaaacatggattggtttgagcagcaataaaattccagtttcctttgaatggtctaatgactcttcagtcatctttactaattggcacacacttgagccccacatttttccaaatagaagccagctgtgtgtctcagcagagcagtctgagggacactggaaagtcaaaaattgtgaagaaagacttttttacatttgtaaaaaagcaggccatgtcctctctgatgctgaatcaggatgtcaagagggatgggagagacatggtggattctgttacaaaattgacacagtccttcgaagctttgaccaagcttccagcggttattactgtcctcctgcacttgtaaccattacaaacaggtttgaacaggcttttattaccagtttgatcagtagtgtggtaaaaatgaaggacagttatttttggatagctcttcaggaccaaaatgatacgggagaatacacttggaagccagtagggcagaaacccgagccggtgcagtacacacactggaacacacaccagccgcgctacagtggtggctgtgttgccatgcgaggaaggcatccacttggtcgctgggaagtgaagcactgtcggcactttaaggcaatgtccttgtgcaagcagccagttgaaaatcaggaaaaagcagagtatgaagagagatggccctttcacccctgctatttggactgggagtcagagcctggtctggccagttgcttcaaggtatttcatagtgaaaaagttctgatgaaaagaacatggagagaagctgaagcattttgcgaagaatttggagctcatcttgcaagctttgcccatattgaggaagagaattttgtgaatgagctcttacattcaaaatttaattggacagaagaaaggcagttctggattggatttaataaaagaaacccactgaatgccggctcatgggagtggtctgatagaactcctgttgtctcttcgtttttagacaacacttattttggagaagatgcaagaaactgtgctgtttataaggcaaacaaaacattgctgcccttacactgtggttccaaacgtgaatggatatgcaaaatcccaagagatgtgaaacccaagattccgttctggtaccagtacgatgtaccctggctcttttatcaggatgcagaatacctttttcatacctttgcctcagaatggttgaactttgagtttgtctgtagctggctgcacagtgatcttctcacaattcattctgcacatgagcaagaattcatccacagcaaaataaaagcgctatcaaagtatggtgcaagttggtggattggacttcaagaagaaagagccaatgatgaatttcgctggagagatggaacaccagtgatataccagaactgggacacaggaagagaaagaactgtgaataatcagagccagagatgtggctttatttcttctataacaggactctggggtagtgaagagtgttcagtttctatgcctagtatctgtaagcgaaaaaaggtttggctcatagagaaaaagaaagatacaccaaaacaacatggaacgtgtcccaaaggatggctatattttaactataagtgccttctgctgaatatccccaaagacccaagcagttggaagaactggacgcatgctcaacatttctgtgctgaagaaggggggaccctggtcgccattgaaagtgaggtggagcaagctttcattactatgaatctttttggccagaccaccagtgtgtggataggtttacaaaatgatgattatgaaacatggctaaatggaaagcctgtggtatattctaactggtctccatttgatataataaatattccaagtcacaataccactgaagttcagaaacacattcctctctgtgccttactctcaagtaatcctaattttcatttcactggaaaatggtattttgaagactgtggaaaggaaggctatgggtttgtttgtgaaaaaatgcaagatacttctggacacggtgtaaatacatctgatatgtatccaatgcccaataccttagaatatggaaacagaacttacaaaataattaatgcaaatatgacttggtatgcagcaataaaaacctgcctgatgcacaaagcacaactggtcagcatcacagaccagtatcaccagtccttcctcactgttgtcctcaaccggctaggatatgcccactggattggactgttcaccacagataatggtcttaattttgactggtctgatggcaccaaatcttctttcactttttggaaagatgaggagtcctccctccttggtgactgcgtttttgccgacagcaacggacgctggcatagcacagcctgcgagtcatttctgcaaggtgccatttgtcatgtgccacctgaaacaagacaatctgaacacccagagttgtgctcagaaacatctattccctggataaaatttaaaagtaattgctacagtttttctacagtcctagacagtatgagttttgaggctgctcatgaattttgcaaaaaggaaggttctaatcttttaacaatcaaggatgaggctgaaaatgcatttctcctagaagagctgtttgcttttggttcttctgtccagatggtttggttgaatgctcaatttgatggtaacagtaagtgatttgggtagaggagaggacataaataaatacatggttgttaaagctgatgataatggcatctgtgagccagaaaactctccttggatacgttttctgagaaaaaatagcatgaagcctaaagccatttcttccaaaaacaacattgcaacccttttctttacccttttgtcttttaaaataatcccagaacaccaaaaataaaaacaaacaataacatgtttatctttacccttagcaggaagatgcttggctggaactttgtgttcacagacttagtcattgcataccaaaaccatatttactggaaaatatcccaggtttctaaatgttataaaagcacaatagagttatggaaatgtttccatgatgaactgtgctgttaggattcttatttgctactcataaaaaccagagtttgtaataaaatggaagcatggtattcttttctttatgtaattgatggttattgaaaggtacttgtgaagaaaattattttaattggtatggagagcttgttacagtggtgtaccaaggttgggggtgagcctaccctttcgaggaggagtattttaatcaccaacattgtttagaatttcaagcagatggtgataataaaaagcagaccaacttttagttagctgtattgttagttttaaattattttcagacaatacactattgcccacacatgggatggactctcctaccgcccctacccccttggtacatggctggcttggtattaaagaaattcactgtaaaatctttttagaaagtgagccattttgtaatgatgaagatgttaggacttcaaaggatttttctttactcgattagttttgtttatcaaatgatttctttaaatcgattatatatatatatggaatatttcaaaattcaaactgtcacattaagaaacatgataacctaaatgacctaaataagaacactgtacctaaaataaagaggcaacttta

SEQ ID NO: 22429 - DNA, 2567 bp, Homo sapiens
cacggatgaaaatagctccgggtgagctctggaacagctgaaaaagctggagcaaccaagcagggcctacaagccgaggagggctgtttaaaggcgcaggggccattttacctccaggttggccctgctcaggaccaggaggaaacacctccagcccgcgacctcctcccacagggggaaaaggaaagcaggaggaccacagaagctttggcaccgaggatccccgcagtcttcacccgcggagattccggctgaaggagctgtccagcgactacaccgctaagcgcagggagcccaagcctccgcaccggattccggagcacaagctccaccgcgcatgcgcacacgccccagacccaggctcaggaggactgagaattttctgaccgcagtgcaccatgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggtaggtgggagaccatagtcgctctgatgcctatgctcgttcagctctactacccgaaggatagtgcccgaagttgctgcttggcatagatgagcctcagcttccagggcactgtgggcctgttggtctactagggccctgatgtccacctggccttcctgttcttcactcccttcagccacacgcttcatggccttgagttcaccttggctgtcctaacagggccaatcaccagtgaccagctagactgtgattttgatagcgtcattcagaagaaggcgtccaaggagctgaaggtggtgaaatttgtcctgcaggtccctcgggagatcctggagctggagcatgagtgtctgacaatcagaagcatcatgtccaatgtccagatggccagaatgaatgtgatagttcagaccaatgccttccactgctcctttatgactgcacttctagccagtagctctgcacaagttagctctgtagaagtaagaacttgggcttaaatcatgggctatctctccacagccaagtggagctctgagaatacaacaagtgctcaataaatgcttgctgattgactgatggatta

SEQ ID NO: 22430 - DNA, 1626 bp, Homo sapiens
atgggaagctctgaagtttccataattcctgggctccagaaagaagaaaaggcggccgtggagagacgaagacttcatgtgctgaaagctctgaagaagctaaggattgaggctgatgaggccccagttgttgctgtgctgggctcaggcggaggactgcgggctcacattgcctgccttggggtcctgagtgagatgaaagaacagggcctgttggatgccgtcacgtacctcgcaggggtctctggatccacttgggcaatatcttctctctacaccaatgatggtgacatggaagctctcgaggctgacctgaaacatcgatttacccgacaggagtgggacttggctaagagcctacagaaaaccatccaagcagcgaggtctgagaattactctctgaccgacttctgggcctacatggttatctctaagcaaaccagagaactgccggagtctcatttgtccaatatgaagaagcccgtggaagaagggacactaccctacccaatatttgcagccattgacaatgacctgcaaccttcctggcaggaggcaagagcaccagagacctggttcgagttcacccctcaccacgctggcttctctgcactgggggcctttgtttccataacccacttcggaagcaaattcaagaagggaagactggtcagaactcaccctgagagagacctgactttcctgagaggtttatggggaagtgctcttggtaacactgaagtcattagggaatacatttttgaccagttaaggaatctgaccctgaaaggtttatggagaagggctgttgctaatgctaaaagcattggacaccttatttttgcccgattactgaggctgcaagaaagttcacaaggggaacatcctcccccagaagatgaaggcggtgagcctgaacacacctggctgactgagatgctcgagaattggaccaggacctccctggaaaagcaggagcagccccatgaggaccccgaaaggaaaggctcactcagtaacttgatggattttgtgaagaaaacaggcatttgcgcttcaaagtgggaatgggggaccactcacaacttcctgtacaaacacggtggcatccgggacaagataatgagcagccggaagcacctccacctggtggatgctggtttagccatcaacactcccttcccactcgtgctgcccccgacgcgggaggttcacctcatcctctccttcgacttcagtgccggagatcctttcgagaccatccgggctaccactgactactgccgccgccacaagatcccctttccccaagtagaagaggctgagctggatttgtggtccaaggcccccgccagctgctacatcctgaaaggagaaactggaccagtggtgatgcattttcccctgttcaacatagatgcctgtggaggtgatattgaggcatggagtgacacatacgacacattcaagcttgctgacacctacactctagatgtggtggtgctactcttggcattagccaagaagaatgtcagggaaaacaagaagaagatccttagagagttgatgaacgtggccgggctctactacccgaaggatagtgcccgaagttgctgcttggcatag

SEQ ID NO: 22431 - DNA, 3584 bp, Homo sapiens
gctggtcctatcccactgggaccgtcgctgccactcagccagagagccagcatcttggcaagggctgggcctggagtgaagctggaagggctagcatggagagcctgtcacctgggggaccacctggccacccttaccagggggaggcctctacctgctggcagctcacagtgagggtcctggaggcgcggaacctgcgctgggctgacctgttgagtgaggccgacccttacgtgatcctacagctgtcgaccgcacctggaatgaagtttaagaccaagacgctcaccgacaccagtcatcctgtgtggaatgaggccttccgtttccttatccaaagtcaggtcaagaatgttctggagcttagcatctatgatgaggactcagtcacggaggatgacatctgcttcaaggttctctatgacatctcagaagtcctccctggcaagctgctccggaaaaccttctcccagagtccccagggagaggaggagctggatgtggagttcctgatggaagaaacgtcagatcgcccagaaaacctcatcaccaacaaagtcattgtggcccgagagctgtcatgcctggatgtgcatctggacagcacagggagcaccgctgtggttgcagatcaggacaagctggagctggagctggtgctgaaggggtcctatgaggacacacagacatccttcctgggcacagcctctgccttccgcttccactacatggcagccctagagacagagctgagcgggcgcctgaggagctccagaagcaatggctggaatggggacaactcagctgggtacctcactgtgcccctgaggcccttgaccattgggaaggaggtgactatggatgttcctgctccaaatgccccaggagtgaggctgcagctcaaggcagagggctgccctgaggagctggccgtgcacctgggcttcaatctctgtgcagaggagcaggccttcctgagcaggaggaagcaggtggtggccaaggccctgaagcaggccctgcagctggacagagacctgcaggaggatgaggtacccgttgtgggcatcatggccacaggaggaggtgcccgggccatgacctcactctacggccacctattggccttgcagaagctgggcctcctagactgtgtgacctacttcagtggcatctctggctctacgtggacaatggcccacctgtacggggaccctgagtggtcgcagagggacctggagggacctatcagatacgcccgggagcacctggccaagagcaagctggaggtcttttccccagagcgcctggcgagctaccgccgggagctggagctgcgggctgagcagggccaccccacgacctttgtggacctgtgggcgctagtgctggagtccatgctgcacggccaggtgatggatcagaagctgtcaggacagagagccgccctggaacggggtcagaaccctctgcccctctacttgagcctcaatgtcaaagagaacaatctggagacactggacttcaaggagtgggttgagttctccccctatgaggtcggtttcctgaagtacggggccttcgtccctcctgagctcttcggctccgagttcttcatgggacggctgatgaggaggatcccggagccccggatctgctttctggaagccatctggagcaacattttctccctgaacctgctggatgcctggtatgacctcaccagttctggggagtcctggaaacagcacatcaaggacaagaccaggagcttagagaaggagcccctgaccacctcggggacctcctcgcggctggaggcctcgtggctgcagccaggcacggcgctggcccaggcatttaaaggcttcctgacaggcaggcccctccaccagcgcagccccaacttcctccagggcctccagctgcaccaggactactgtagccacaaagacttctccacctgggcagactaccagcttgactccatgcccagccagctgacccccaaggagccccggctctgcctggtggacgccgcctacttcatcaacaccagctctccctccatgttccggccaggccgcaggctggacctcatcctctccttcgactactccctatctgcgcccttcgaggcactgcagcagacggagctgtactgccgggcccgggggctgcccttcccccgggtggaacccagccctcaggaccagcaccagccaagggaatgccacctcttctcagaccccgcctgccccgaggccccgatcctgctgcacttcccgctggtcaatgcctccttcaaggaccactcagcccccggtgtccagcgcagccccgcagagctccagggtggccaagtggatctcaccggggccacctgcccctacaccctgtccaacatgacctacaaggaggaagacttcgagcgcctgctgcggctcagtgactacaacgtgcagaccagccagggtgccatcctgcaggccctgaggaccgcgctgaagcaccggactctagaggcgaggcctccaagggcacagacctgaggttgctcagaggctgcaggaccctccagggcctgcgggcataacctgatctgtagctgggctcagccacaggccttcctggttggagttctgggctctcccaggcctgggtggcctctgtagctggtctcactgcccagagggaactgcacacacagacttctctcttacgttcatggctggcttgagatgagttgaaaataacttcgccaggccagtgtgtagaacagctggtccaaccagacagactttcacaccacaattacttccatgcctgagcaggatagatttgaagtgcaagccggaggcagcagatcaggagtagggacaggaaggacaggggatgcctgacctgacaggtggcttcaggcctcgggaatcacaagacatcctgaacacattgcctcctcatcttcttcctgctcctccacctcctcctctccttgtccttctcctctttgtcctcctgctttccgtatccaagtcttgtacttgtttaaatttattcctaaatattttattctttttgataagtggagttactttcttaatttcatttagattattcattgctattttatagaaatacaatggatttttaaatgttgatcttgtattccgcaatcttgctgaagttgtttaccggctctaatacttttgcggatttcttagaattttctgtagacagatcatgccatctccaaatagagatggttttacttcttcctgtctgatctgaatgccttttatttatttttcccaattgccctgagcagtacaatgatgaacacacgtttcaagagcagacatcttgtcttgttcctgactctgacaagaaagcataagtctctcaccatttagtgtgattttagctgtgggtttttcttggacatccttatcaggttgagaaagttctcttttatttctagtttattgagtgttttatgatgaaacggtgttaggttttgtcaagtgatttttctgtgtctatgggcatgatcatgtggttttgtcgtgtattttattaatgta

SEQ ID NO: 22432 - DNA, 1882 bp, Homo sapiens
gccagagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattcatatcagcctaaattttaattttaaagatgattccttttcagtgtcgaagttaaaaactgtttttacattactttgacagacaagtagattaaaacaggcaaaatcccagtgaaaa

SEQ ID NO: 22433 - DNA, 1747 bp, Homo sapiens
ggaaaaccggcctgactggggggtgaattcagcagggagtaaatctgatcggcatcaggtctgcggaaaggagctggtgagcacgacaccacccaggcattgcctggctctctccgcggcgggctaagttaaccgcgggtccaggagactaagctgaaactgctgctcagctcccaagatggtgccacccaaattgcatgtgcttttctgcctctgcggctgcctggctgtggtttatccttttgactggcaatacataaatcctgttgcccatatgaaatcatcagcatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggactctattgatagggaaaaaatagcagtaattggacattcttttggtggagcaacggttattcagactcttagtgaagatcagagattcagatgtggtattgccctggatgcatggatgtttccactgggtgatgaagtatattccagaattcctcagcccctcttttttatcaactctgaatatttccaatatcctgctaatatcataaaaatgaaaaaatgctactcacctgataaagaaagaaagatgattacaatcaggggttcagtccaccagaattttgctgacttcacttttgcaactggcaaaataattggacacatgctcaaattaaagggagacatagattcaaatgtagctattgatcttagcaacaaagcttcattagcattcttacaaaagcatttaggacttcataaagattttgatcagtgggactgcttgattgaaggagatgatgagaatcttattccagggaccaacattaacacaaccaatcaacacatcatgttacagaactcttcaggaatagagaaatacaattaggattaaaataggttttttaaaagtcttgtttcaaaactgtctaaaattatgtgtgtgtgtgtgtgtgtgtgtgtgtgtgtgagagagagagagagagagagagagagagagagagagaattttaatgtattttcccaaaggactcatattttaaaatgtaggctatactgtaatcgtgattgaagcttggactaagaattttttccctttagatgtaaagaaagaatacagtatacaatattc

SEQ ID NO: 22434 - DNA, 1709 bp, Homo sapiens
agagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgacatgggtcaacaaaatacaagtactgatggctgctgcaagctttggccaaactaaaatcccccggggaaatgggccttattccgttggttgtacagacttaatgtttgatcacactaataagggcaccttcttgcgtttatattatccatcccaagataatgatcgccttgacaccctttggatcccaaataaagaatatttttggggtcttagcaaatttcttggaacacactggcttatgggcaacattttgaggttactctttggttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggtaagctataaaaagtaatttttctcttgtcctacagttctttattgttttttgtcatttaattttctgctatattgcaaggtacaatatgataaagggctgcaaccagccccctccccaatgcgcacacacagacacacaaagcagtacaggtaaagtattgcagcaatgaagaatgcattatcttggactagatatgaaattgccaaaagttagtcagttttgatctacaaaaacagcaatgtcatatggttcaactcaactcctgtggaagtattattatttcatggacagctcctgcatgtttttaagcttgatcttgaaaacttgacacaagtttgggagcgggtggaaaaatatcagacagagtgggcagcatgaacaaagactcaaaagtgtgtgtggcatgtgaagtgcagggattagggggaactagagaataagatgatggtctgttctccagatacaatgaagaaatttgttatccctcaagcagccactctcttctgtatccttgcctttgtacatgttgtccccttggcctgacacacccttccccttgcctaactcctacctaatttcaagactccagttgagcatcacctcctctaagaagctttcttggaccccaatacccacttctggactgggctcgctgtctgtcatgtgtgctcctttgtaccactgtactgtattgcatcatgcctctgtataactttcttccctgatggactgcaaactcactgaaatgagactgcagtacctggcacagagtaggtactcaataaatactcatggaatgaacaaacaaataaacatggggtgaggagaggcagaagtcagaactgatgttgaagtttccagtgtgggtgactacaaag

SEQ ID NO: 22435 - DNA, 1210 bp, Homo sapiens
aggccgcgctaggcggacccaggacacagcccgcgcgcagcccacccgcccgccgcctgccagagctgctcggcccgcagccagggggacagcggctggtcggaggctcgcagtgctgtcggcgagaagcagtcgggtttggagcgcttgggtcgcgttggtgcgcggtggaacgcgcccagggaccccagttcccgcgagcagctccgcgccgcgcctgagttcaatgacaactcctgcaaactggaattcccctctgaggcctggtgaaaaatatccacttgttgttttttctcatggtcttggggcattcaggacactttattctgctattggcattgacctggcatctcatgggtttatagttgctgctgtagaacacagagatagatctgcatctgcaacttactatttcaaggaccaatctgctgcagaaataggggacaagtcttggctctaccttagaaccctgaaacaagaggaggagacacatatacgaaatgagcaggtacggcaaagagcaaaagaatgttcccaagctctcagtctgattcttgacattgatcatggaaagccagtgaagaatgcattagatttaaagtttgatatggaacaactgaaggtaagctataaaaagtaatttttctcttgtcctacagttctttattgttttttgtcatttaattttctgctatattgcaaggtacaatatgataaagggctgcaaccagccccctccccaatgcgcacacacagacacacaaagcagtacaggtaaagtattgcagcaatgaagaatgcattatcttggactagatatgaaattgccaaaagttagtcagttttgatctacaaaaacagcaatgtcatatggttcaactcaactcctgtggaagtattattatttcatggacagctcctgcatgtttttaagcttgatcttgaaaacttgacacaagtttgggagcgggtggaaaaatatcagacagagtgggcagcatgaacaaagactcaaaagtgtgtgtggcatgtgaagtgcagggattagggggaactagagaataagatgatggtctgttctccagatacaatgaagaaatttgttatccctcaagcagccactctcttctgtatccttgcctttgtacatgttgtccccttggcctgacacacccttccccttgcctaactcctacctaatttcaagact

SEQ ID NO: 22436 - DNA, 2594 bp, Homo sapiens
cttcctggaagggtgcgataaggccgggcgaggtgcctgggatgcttctccccttccgcgaggaagagatctaattgggtagggcgggtgtagactagcctgccgagccgcccgctggcacctgcagcctcctgggcgcccgccgggccccggcgagaaagttgttaaagggagcgaggtggttgttcctggggtccgaggcgcgcctctcacgccctgcccaacagaagccgcagtcccgtggggtctggagacgcagtttcctgttaatgacaataaatccctgctccccctgcctcagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttgaaaaaaaaaaagtcctcggctataaggaaatttagtatagatgcttgccaatcttactaaaatttcccttattttcctttgctctacacgtctttcctttgccttgttgcttccatctccttggcactcctgcttcctcactgcttctgcttgccatgatccccaagtctctgacccaccttcctgcctgctcctctcctcccacattggctcagattctttccccgctgtctgtgggtccacactcccagtggcacctccaggagagaatctgattggctcagttcgccagataactcaactttcccattggctacctttgggtcaggtgatctccactagacctatcgcctatgcctgatggtgggtcacatggtgcaaatgttgcctgagagcttagtggattagggatgtggctgggctcatggttgacgtccctgctgctgagcccttacgggtcaggctgggagaaggtaccatgttgtgtgactggtcatttgaggtcttgcagctgttgcttgctgggcttggcaggtgttcaaagtgaccatttttctgaagggtttttttctgagtattcctcagatgtactcccctggggccgacggtctttccttccacagggcgatgcttccctacttgcttgtgaatgtttccttcatctccaggttgtctggggacaattctgtcttttggaggcctgggcaggatttacagagggctccatgccagctccttcctgccgggtccacttctggtgtagggtaaacacctgcccattcatgtcctagtgttgatagaataatcattttctttcagtacagtttcctttttttttttttttgccccggctttttagatgtagcacttaatgccagttctcgagctccccaaacttaagggacacaggtcaacaagcagtaggtctttggaagctcgctctctcacatggtataaggtgagggggacacatggaatgtaaacctccaaactaattatgggggaaaaaggaatgagaaaaacaaacacaagaaggcaaaacaaaaacacctggttcaattaaaaacaacaacaaagcaaaacaaaaaaaacccaaaaccaaaccacacaataaatgagaaaaaaattacataaaacagatgacatgtatagaaataaaaaaatagaatggaggaactaattccaaatatataagtaatcctaagtggactaaatttgcaaagtaaaaggcaaacattacactggattaaaaaacaaatccagggaatacagtttacag

SEQ ID NO: 22437 - DNA, 1099 bp, Homo sapiens
gggtgacctcacgccggcccggccaccgcggccattagacccggtccaattgctggggctgcagcgctgcctccgagaccgcgagacatctacgcagcgaaatcgagcctggccttgagggtccacaccgcgagggaagatgcgtgcgcccattccagagcctaagcctggagacctgattgagatttttcgccctttctacagacactgggccatctatgttggcgatggatatgtggttcatctggcccctccaagtgaggtcgcaggagctggtgcagccagtgtcatgtccgccctgactgacaaggccatcgtgaagaaggaattgctgtatgatgtggccgggagtgacaagtaccaggtcaacaacaaacatgatgacaagtactcgccgctgccctgcagcaaaatcatccagcgggcggaggagctggtggggcaggaggtgctctacaagctgaccagtgagaactgcgagcactttgtgaatgagctgcgctatggagtcgcccgcagtgaccaggtcagagatgtcatcatcgctgcaagcgttgcaggaatgggcttggcagccatgagccttattggagtcatgttctcaagaaacaagcgacaaaagcaataactgaaaaagactgtcctgtcagcgatgactttatacatcaagggggtcttgttttgctagagagtttggggtttggtttgtggatttcattgtgatttataataaggcttattttcacagaataaaataaagcaaaacgagggaggattttattgggggaagtgcagcaagaactgcctggtgtgaagtctgttcagggaacagccgggctgtcttcctggtcagggattgtctttcactttctttttgcgtgctgtgttctttgcattgcaggaggcagagtccagctccagttatctcaagtagagggcgtttctggtcgtcaggatacatgcggggcggaagggagacagaaagacataatacacaagaacagaaagcagcagacagccaggacccttggcccggaactagatctaggatggcctctgagactcagcagctggagtctgtagatgttcagctgagttg

SEQ ID NO: 22438 - DNA, 5107 bp, Homo sapiens
ggagcagctcttccagaggcccgagtcacctggagcattctggcatggggctgcggccaggcattttcctcctggagctgctgctgcttctggggcaagggacccctcagatccatacctctcctagaaagagtacattggaagggcagctatggccagagaccctgaagaattctccattcccatgcaacccaaataaattaggagtgaatatgccttctaaatcagttcactctctgaagccttctgatattaaatttgtggcagccattggcaatctggaaattcctccagacccagggacgggcgatctggagaagcaagactggactgaaaggccacagcaggtgtgcatgggagtgatgacagtcctttcagacatcatcagatatttcagtccttctgttccaatgcctgtgtgccacactggaaagagagtcataccccacgatggtgctgaagacttgtggattcaggctcaagaactggtgagaaacatgaaagagaacctgcaacttgactttcaatttgactggaagctcatcaatgtgttcttcagtaatgcaagccagtgttacctgtgcccctctgctcaacagaatgggcttgcggcgggcggcgtggatgagctgatgggggtgctggactacctgcagcaggaggtccccagagcatttgtaaacctggtggacctctctgaggttgcagaggtctctcgtcagtatcacggcacttggctcagccctgcaccagagccctgtaattgctcagaggagaccacccggctggccaaggtggtgatgcagtggtcttatcaggaagcctggaacagcctcctggcctccagcaggtacagtgagcaggagtccttcaccgtggttttccagcctttcttctatgagaccaccccatctctacactcggaggacccccgactccaggattctaccacgctggcctggcatctctggaataggatgatggagccagcaggagagaaagatgagccattgagtgtaaaacacgggaggccaatgaagtgtccctctcaggagagcccctatctgttcagctacagaaacagcaactacctgaccagactgcagaaaccccaagacaagcttgaggtaagagaaggagcggaaatcagatgtcctgacaaagacccctccgatacggttcccacctcagttcataggctgaagccggctgacatcaacgtaattggagccctgggtgactctctcacggcaggcaatggggccgggtccacacctgggaacgtcttggacgtcttgactcagtaccgaggcctgtcctggagcgtcggcggagatgagaacatcggcaccgttaccaccctggcgaacatcctccgggaattcaacccttccctgaagggcttctctgttggcactgggaaagaaaccagtcctaatgccttcttaaaccaggctgtggcaggaggccgagctgaggatctacctgtccaggccaggaggctggtggacctgatgaagaatgacacgaggatacactttcaggaagactggaagataataaccctgtttataggcggcaatgacctctgtgatttctgcaatgatctggtccactattctccccagaacttcacagacaacattggaaaggccctggacatcctccatgctgaggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgctggcaatggaattggctccaaaccagacgacctccccgatgtcaccacacagtatcggggactgtcatacagtgcaggaggggacggctccctggagaatgtgaccaccttacctaatatccttcgggagtttaacagaaacctcacaggctacgccgtgggcacgggtgatgccaatgacacgaatgcattcctcaatcaagctgttcccggagcaaaggctgaggatcttatgagccaagtccaaactctgatgcagaagatgaaagatgatcatagagtaaatttccatgaagactggaaggtcatcacagtgctgatcggaggcagcgatttatgtgactactgcacagattcgaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgtcgcagcctggcagagaggtcaaactccttcaataaccaagaagccacgtgatgatgtgtaactactagggcatcagtaggtaaatgtgtctgattgttttaaagaatagaaagggttcttcggggaaagtttcttgggggagagcaaccttcacat

SEQ ID NO: 22439 - DNA, 3537 bp, Homo sapiens
cagctctgtcctggctggctgggccccacctcaacctctgctgtgcagcttttccttctaggagagatggagccagcaggagagaaagatgagccattgagtgtaaaacacgggaggccaatgaagtgtccctctcaggagagcccctatctgttcagctacagaaacagcaactacctgaccagactgcagaaaccccaagacaagcttgaggtaagagaaggagcggaaatcagatgtcctgacaaagacccctccgatacggttcccacctcagttcataggctgaagccggctgacatcaacgtaattggagccctgggtgactctctcacggcaggcaatggggccgggtccacacctgggaacgtcttggacgtcttgactcagtaccgaggcctgtcctggagcgtcggcggagatgagaacatcggcaccgttaccaccctggcgaacatcctccgggaattcaacccttccctgaagggcttctctgttggcactgggaaagaaaccagtcctaatgccttcttaaaccaggctgtggcaggaggccgagctgaggatctacctgtccaggccaggaggctggtggacctgatgaagaatgacacgaggatacactttcaggaagactggaagataataaccctgtttataggcggcaatgacctctgtgatttctgcaatgatctggtccactattctccccagaacttcacagacaacattggaaaggccctggacatcctccatgctgaggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgctggcaatggaattggctccaaaccagacgacctccccgatgtcaccacacagtatcggggactgtcatacagagaaagtaaaccagggttcttatcagactcctgggtcagcaaatccaacaggaaatgcaccagaaaagcaccaaatccctgaatcttcacctccccgcttgcatgtatacgtgtacacgtggtgttcctacgtctctgtttactgtctttatgtgtttattcatgttgtcttgtagtcacacagctgcctttacatatatgtacacatctgcacagaaaacctctgaaacccatcgcacacttcgagaggccataaccaagacacaatcacaatcagccatgtcttgaaagattagcaattcgacaagaggaaagggtgagaaagggcatcccgaacacggaagtggagaagctcagggtgtgtcaggcgagcggttgcgtgtagatattctcaagtttctttctctcctaataaagttctcattcctgtaggcttcaaagtaagtggcgagtagctcagaatttacctgggaaaacaactagaacgaagctggccacaagggggcagcgtgctaatgagtggcggagccaggacagcacctttgctgccgcctcccttttcttctgagtcagtttgcttcctggggaagtgacagggagcagggagggggtgatcaagactgtgaaggttctctggccagacctgagcagagtcccagagaggatgggtttccagggcgagagggaggcgccatcactcggcctgtaccacccacaacgaggacctaggttgtccttagcatgaggacatcaacctctcaagaacagaggtcagtgccttcctgcgccaaggtccctgcgtttccacaagtccttggtcaggtacctggtcctaacaggctgccatggaacaaatcagagcctcactgactcaccattctgctcctaatgaggctacaagaaaaaaaaccagaggagagaaagcagagcttattacaatcaggaaagagcatgaggttctggcagctgcacttggtctcagctaaagaaggcaatgacctcatacgatagcatgggaaacaaaaatcaagcagacgaaccacattgcaggtgatagatacgcgacgtgcacctggtggggcagcctggggaagtgaggtgatgtgccctactttaaaacagatcgaccagctgggctcctgggattcagatatgaaccagcagtcctctactaaaagtttctttctgcagcgatgggaaaattcagccattgctctgtttcttccaacaagtgaagtccattacagcctaatgtctcaatcttttagttctagctctaaggcctcaggttcaatggctgctgtccctttaaacccttcatttgtcctaaatgtttcaaatagctgcccccaaatgcacgtgtgttaaagatggaagctctaggtcggggtctgagagacagcttgacacttggtagaatacatagactactgtgtctcaaagtgtgttccatggaacattaactccagacctgttcctggagaagagaaaatcctttgtatctgagggggaaacattaccataaccttcctttggggaattcatgtgtgtattagcatattaaaggctctcataaggcctgcaatgcagaaatctatttaagttttatctgtttaacccaatgtttcccttaattccagaacattttctttgttcataacacctgttaacacctcctgaaagtgttcacgtagtagacttatctgagaaaagcaatttttgagccgttaaagcttctagattggacaaactaggcaattaatgatactagatcaattcagaatgcaatttgagcctcttccccctgggaaacaaagtgaaaagagtggatctcatggaattaggggagaagtagacccagaattcatggggggtgggtggctgtgaacaggacctgcagaagaggctcggctgtgaatatttccaaggccccttgacctgtgagattctgtagtgaacggttccagctttggccagcttaacaatgtgctgggccccaaggtcttgagagcattgccttttcttccattgaaataagttcgcttgtttgggaccattcaaaggatcaaaataaaatttacttacc

SEQ ID NO: 22440 - DNA, 5115 bp, Homo sapiens
ggagcagctcttccagaggcccgagtcacctggagcattctggcatggggctgcggccaggcattttcctcctggagctgctgctgcttctggggcaagggacccctcagatccatacctctcctagaaagagtacattggaagggcagctatggccagagaccctgaagaattctccattcccatgcaacccaaataaattaggagtgaatatgccttctaaatcagttcactctctgaagccttctgatattaaatttgtggcagccattggcaatctggaaattcctccagacccagggacgggcgatctggagaagcaagactggactgaaaggccacagcaggtgtgcatgggagtgatgacagtcctttcagacatcatcagatatttcagtccttctgttccaatgcctgtgtgccacactggaaagagagtcataccccacgatggtgctgaagacttgtggattcaggctcaagaactggtgagaaacatgaaagagaacctgcaacttgactttcaatttgactggaagctcatcaatgtgttcttcagtaatgcaagccagtgttacctgtgcccctctgctcaacaggcaccctcacttagcacggttctcctctcacagaatgggcttgcggcgggcggcgtggatgagctgatgggggtgctggactacctgcagcaggaggtccccagagcatttgtaaacctggtggacctctctgaggttgcagaggtctctcgtcagtatcacggcacttggctcagccctgcaccagagccctgtaattgctcagaggagaccacccggctggccaaggtggtgatgcagtggtcttatcaggaagcctggaacagcctcctggcctccagcaggtacagtgagcaggagtccttcaccgtggttttccagcctttcttctatgagaccaccccatctctacactcggaggacccccgactccaggattctaccacgctggcctggcatctctggaataggatgatggagccagcaggagagaaagatgagccattgagtgtaaaacacgggaggccaatgaagtgtccctctcaggagagcccctatctgttcagctacagaaacagcaactacctgaccagactgcagaaaccccaagacaagcttgaggtaagagaaggagcggaaatcagatgtcctgacaaagacccctccgatacggttcccacctcagttcataggctgaagccggctgacatcaacgtaattggagccctgggtgactctctcacggcaggcaatggggccgggtccacacctgggaacgtcttggacgtcttgactcagtaccgaggcctgtcctggagcgtcggcggagatgagaacatcggcaccgttaccaccctggcgaacatcctccgggaattcaacccttccctgaagggcttctctgttggcactgggaaagaaaccagtcctaatgccttcttaaaccaggctgtggcaggaggccgagctgaggatctacctgtccaggccaggaggctggtggacctgatgaagaatgacacgaggatacactttcaggaagactggaagataataaccctgtttataggcggcaatgacctctgtgatttctgcaatgatctggttcctcgggcatttgtgaacctggtgacggtgcttgagatcgtcaacctgagggagctgtaccaggagaaaaaagtctactgcccaaggatgatcctcaggtctctgtgtccctgtgtcctgaagtttgatgataactcaacagaacttgctaccctcatcgaattcaacaagaagtttcaggagaagacccaccaactgattgagagtgggcgatatgacacaagggaagattttactgtggttgtgcagccgttctttgaaaacgtggacatgccaaagacctcggaaggattgcctgacaactctttcttcgctcctgactgtttccacttcagcagcaagtctcactcccgagcagccagtgctctctggaacaatatgctggagcctgttggccagaagacgactcgtcataagtttgaaaacaagatcaatatcacatgtccgaaccaggtccagccgtttctgaggacctacaagaacagcatgcagggtcatgggacctggctgccatgcagggacagagccccttctgccttgcaccctacctcagtgcatgccctgagacctgcagacatccaagttgtggctgctctgggggattctctgaccgctggcaatggaattggctccaaaccagacgacctccccgatgtcaccacacagtatcggggactgtcatacagtgcaggaggggacggctccctggagaatgtgaccaccttacctaatatccttcgggagtttaacagaaacctcacaggctacgccgtgggcacgggtgatgccaatgacacgaatgcattcctcaatcaagctgttcccggagcaaaggctgaggatcttatgagccaagtccaaactctgatgcagaagatgaaagatgatcatagagtaaatttccatgaagactggaaggtcatcacagtgctgatcggaggcagcgatttatgtgactactgcacagattcgaatctgtattctgcagccaactttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcgttttgtgtaactgcgttctgaccctgcgggagaactcccaagagctagccaggctggaggccttcagccgagcctaccggagcagcatgcgcgagctggtggggtcaggccgctatgacacgcaggaggacttctctgtggtgctgcagcccttcttccagaacatccagctccctgtcctggcggatgggctcccagatacgtccttctttgccccagactgcatccacccaaatcagaaattccactcccagctggccagagccctttggaccaatatgcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctattttattcctgggtttgcctgcgtgaagcactcaccttccatctcttgtgcagcccaggtgtgggagctgccactttttgtggcctgcctccagcagggctgcccaagccacgaccaaccagagcccaaactgcctgccaccacgagcatatcctcaagtcaccaaacccactatttcaaaggcagaaaaaatgctggtcaccaggtggtggctggaattttggagctggctggttgccattcagtccaatccaacacatacctattaagcaactgttttgtatccaggacaatgcgaagcactgaggtgcctcctaggctgtgcatgtcgcagcctggcagagaggtcaaactccttcaataaccaagaagccacgtgatgatgtgtaactactagggcatcagtaggtaaatgtgtctgattgttttaaagaatagaaagggttcttcggggaaagtttcttgggggagagcaaccttcacatgtcattttgggaaaaggaataaaaaatgattgggacacaaa

SEQ ID NO: 22441 - DNA, 1672 bp, Homo sapiens
ctttgttcaccatctccgcaatgccttggacgtcctgcatagagaggtgcccagagtcctggtcaacctcgtggacttcctgaaccccactatcatgcggcaggtgttcctgggaaacccagacaagtgcccagtgcagcaggccagcttgaaccacttggaagcaaaacagagaccctggacctgagagcagagatgcccatcacctgtcccactcagaatgagcccttcctgagaacccctcggaatagtaactacacgtaccccatcaagccagccattgagaactggggcagtgacttcctgtgtacagagtggaaggcttccaatagtgttccaacctctgtccaccagctccgaccagcagacatcaaagtggtggccgccctgggtgactctctgactacagcagtgggagctcgaccaaacaactccagtgacctacccacatcttggaggggactctcttggagcattggaggggatgggaacttggagactcacaccacactgcccaacattctgaagaagttcaacccttacctccttggcttctctaccagcacctgggaggggacagcaggactaaatgtggcagcggaaggggccagagctagggacatgccagcccaggcctgggacctggtagagcgaatgaaaaacagccccgacatcaacctggagaaagactggaagctggtcacactcttcattggggtcaacgacttgtgtcattactgtgagaatccggaggcccacttggccacggaatatgttcagcacatccaacaggccctggacatcctctctgaggagctcccaagggctttcgtcaacgtggtggaggtcatggagctggctagcctgtaccagggccaaggcgggaaatgtgccatgctggcagctcagaacaactgcacttgcctcagacactcgcaaagctccctggagaagcaagaactgaagaaagtgaactggaacctccagcatggcatctccagtttctcctactggcaccaatacacacagcgtgaggactttgcggttgtggtgcagcctttcttccaaaacacactcaccccactgaacgagagaggggacactgacctcaccttcttctccgaggactgttttcacttctcagaccgcgggcatgccgagatggccatcgcactctggaacaacatgctggaaccagtgggccgcaagactacctccaacaacttcacccacagccgagccaaactcaagtgcccctctcctgagagcccttacctctacaccctgcggaacagccgattgctcccagaccaggctgaagaagcccccgaggtgctctactgggctgtcccagtggcagcgggagtcggccttgtggtgggcatcatcgggacagtggtctggaggtgcaggagaggtggccggagggaagatcctccaatgagcctgcgcactgtggccctctaggcccgggggtgggtcctcaccctaaactccctatagccactctcttcaccgccctctgccccagccactcccggccaccaggacatgcttcaatgcctggtgccataggaagcccaggggacagtcacaacttcttggggcctgggcttcttccaggcctatgctcctggaatggatacatttaaataaagtccaaagctatttt

SEQ ID NO: 22442 - DNA, 3946 bp, Homo sapiens
ccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagaagctgatgacggtggtgtctgggccagacccagtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcaggga

SEQ ID NO: 22443 - DNA, 6729 bp, Homo sapiens
ggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 22444 - DNA, 1856 bp, Homo sapiens
aaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagagggtggatttctgcatgatgaaattatgagactcacccgtaatacgctggaaaaactgatggccttacctcttacccatgtggtgcccatccaaagcaagatgctgtcataa

SEQ ID NO: 22445 - DNA, 3854 bp, Homo sapiens
cagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccaggtaggactggatgggaggggtcgcttttgagagaagggtggtgtgtagccatccagttttcaggcatcacggacttgctcgtttgtccttcatcctccctttctctacattcccatcttttttttctgctaaagttcccagccacacccatgatcatttcctcatcctttctgccttcctctggtattaatttctccatcattgtgctctctcttcctgacataaatctcattcttccatattgtcttcttcctctttctccattttgtttctctattggcaaatttggcttcctttttaatctggattt

SEQ ID NO: 22446 - DNA, 7295 bp, Homo sapiens
cagcgagcgagggtggcggggaaggggggcgggggggaggaggagggaggagggaaaagagcggttagggggggcgccgggcgtgtgtcactcgctctctccctctgtgtatagaggatgtgctgaatggtgcgctttgaggcggcggcggcggaggagcagaatccgccgcgactggcagcctcggctgaccggctcggcttctcttcgccttccgaggctcctcatccaccgcgggctccagacctcgcgtcccgcccggggcatggccgggcgctgcgcccccgcgcgctctgcctgctgagcggcgccggagggaggtgcggaggccgggaggccggggaggccggcggggagcagagtcgagcgcctccggagcagagaaaggagcccgcgccccgcgccccgcgccccgcgcacggtccccagtccctgccgcgctcgcccgggccgcccggagcccagatgagcccagatggccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 22447 - DNA, 697 bp, Homo sapiens
gccggggctcaacccggagtgcacgccttgcaactcaagcccgtgtgcgtgtccgacagcctcaagaagggcaccaaattcgtcaagtgggatgatgactcaactattgttactccaattattttgaggactgaccctcagggatttttcttttactggacagatcaaaacaaggagacagagctactggatctcagccttgtcaaagatgccagatgtgggagacacgccaaagctcccaaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaagggtggaaaaagctaatgaggctgcgaaaagtgagcagagctgtggaaaggctcccccaaaacattttcaccttcattttataaagcaaaataaaatgcttgaacctg

SEQ ID NO: 22448 - DNA, 288 bp, Homo sapiens
gaagaagcgcaaagtaaacggcaagaaaaactcgtagagaaacacaaggaaatacgtcagcagatcctggatgaaaagcccaaggtaccatgatgaattcctctgtgcttttcttccatgaggttgctccatgaccatctttttgtgtctggatttgaaggttgcccatgaagattgttggttccatgtcaaactaaagcatttcttgagggtttttcttcatggcttaaaaacgttgtgccttaaagctgtgattttattaataaaataataaatcatgactgttaa

SEQ ID NO: 22449 - DNA, 707 bp, Homo sapiens
attatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagagggtggatttctgcatgatgaaattatgagactcacccgtaatacgctggaaaaactgatggccttacctcttacccatgtggtgcccatccaaagcaagatgctgtcataagttttagtagagacgggatttcaccatgttagccaggatggtctcgatctcctgacctcgggatccacccgcctcggcctcccaaagtgctgggattacaggcatgagccaccgcg

SEQ ID NO: 22450 - DNA, 6462 bp, Homo sapiens
acccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 22451 - DNA, 6580 bp, Homo sapiens
acccaggaccccaaattacgtgaacttttggatgtggggaacatcgggcgcctggagcagcgcatgatcacagtggtgtatgggcctgacctcgtgaacatctcccatttgaatctcgtggctttccaagaagaagtggccaaggaatggacaaatgaggttttcagtttggcaacaaacctgctggcccaaaacatgtccagggatgcatttctggaaaaagcctatactaaacttaagctgcaagtcactccagaagggcgtattcctctcaaaaacatatatcgcttgttttcagcagatcggaagcgagttgaaactgctttagaggcttgtagtcttccatcttcaaggaatgattcaatacctcaagaagatttcactccagaagtgtacagagttttcctcaacaacctttgccctcgacctgaaattgataacatcttttcagaatttggtgcaaaaagcaaaccatatcttaccgttgatcagatgatggattttatcaaccttaagcagcgagatcctcggcttaatgaaatactttatccacctctaaaacaagagcaagtccaagtattgattgagaagtatgaacccaacaacagcctcgccagaaaaggacaaatatcagtggatgggttcatgcgctatctgagtggagaagaaaacggagtcgtttcacctgagaaactggatttgaatgaagacatgtctcagcccctttctcactatttcattaattcctcgcacaacacctacctcacagctggccaactggctggaaactcctctgttgagatgtatcgccaagtgctcctgtctggttgtcgctgtgtggagctggactgctggaagggacggactgcagaagaggaacctgtcatcacccatggcttcaccatgacaactgaaatatctttcaaggaagtgatagaagcaattgcggagtgtgcatttaagacttcaccttttccaattctcctttcgtttgagaaccatgtggattccccaaagcagcaagccaagatggcggagtactgccgactgatctttggggatgcccttctcatggagcccctggaaaaatatccactggaatctggagttcctcttccaagccctatggatttaatgtataaaattttggtgaaaaataagaagaaatcacacaagtcatcagaaggaagcggcaaaaagaagctctcagaacaagcctccaacacctacagtgactcctccagcatgttcgagccctcatccccaggagccggagaagctgatacggaaagtgacgacgacgatgatgatgatgactgtaaaaaatcttcaatggatgaggggactgctggaagtgaggctatggccacagaagaaatgtctaatctggtgaactatattcagccagtcaagtttgagtcatttgaaatttcaaaaaaaagaaataaaagttttgaaatgtcttccttcgtggaaaccaaaggacttgaacaactcaccaagtctccagtggaatttgtagaatataacaaaatgcagcttagcaggatatatccaaaaggaacacgtgtggattcatccaactatatgcctcagctcttctggaatgcaggttgtcagatggtggcacttaatttccagacaatggacctggctatgcaaataaatatggggatgtatgaatacaacgggaagagtggctacagattgaagccagagttcatgaggaggcctgacaagcattttgatccatttactgaaggcatcgtagatgggatagtggcaaacactttgtctgttaagattatttcaggtcagtttctttctgataagaaagttgggacttacgtggaagtagatatgtttggtttgcctgtggatacaaggaggaaggcatttaagaccaaaacatcccaaggaaatgctgtgaatcctgtctgggaagaagaacctattgtgttcaaaaaggtggttcttcctactctggcctgtttgagaatagcagtttatgaagaaggaggtaaattcattggccaccgtatcttgccagtgcaagccattcggccaggctatcactatatctgtctaaggaatgaaaggaaccagcctctgacgctgcctgctgtctttgtctacatagaagtgaaagactatgtgccagacacatatgcagatgtcatcgaagctttatcaaacccaatccgatatgtgaacctgatggaacagagagctaagcaattggctgctttgacactggaagatgaagaagaagtaaagaaagaggctgatcctggagaaacaccatcagaggctccaagtgaagcgagaacgactccagcagaaaatggggtgaatcacactacaaccctgacacccaagccaccctcccaggctctccacagccagccagctccaggttctgtaaaggcacctgccaaaacagaagatcttattcagagtgtcttaacagaagtggaagcacagaccatcgaagaactaaagcaacagaaatcgtttgtgaaacttcaaaagaaacactacaaagaaatgaaagacctggttaagagacaccacaagaaaaccactgaccttatcaaagaacacactaccaagtataatgaaattcagaatgactacttgagaaggagagccgctttggaaaagtccgccaaaaaggacagtaagaaaaaatcggaacccagcagccctgatcatggttcatcaacgattgagcaagacctcgctgctctggatgctgaaatgacccaaaagttaatagacttgaaggacaaacaacagcagcagctgcttaatcttcggcaagaacagtattatagtgaaaaataccagaagcgagaacatattaaactgcttattcaaaagttgacggatgtcgcagaagagtgtcagaacaatcagttaaagaagctcaaagaaatctgtgagaaagaaaagaaagaattaaagaagaaaatggataaaaagaggcaggagaagataacagaagctaaatccaaagacaaaagtcagatggaagaggagaagacagagatgatccggtcatatatccaggaagtggtgcagtatatcaagaggctagaagaagcgcaaagtaaacggcaagaaaaactcgtagagaaacacaaggaaatacgtcagcagatcctggatgaaaagcccaagggggaaggttcctcctcattcttgtcggaaacttgccatgaggatccctctgtttcccccaactttactccccccaaccctcaagctctcaagtggtgaccaccgtccttccggccagctgcaggtggagctggagcaagaataccaagacaaattcaaaagactgcccctcgagattttggaattcgtgcaggaagccatgaaaggaaagatcagtgaagacagcaatcacggttctgcccctctctccctgtcctcagaccctggaaaagtgaaccacaagactccctccagtgaggagctgggaggagacatcccaggaaaagaatttgatactcctctgtgaatgctcctgccaggccttcagaaattgcatggccactccagcgtcatcggactctctcttattacaaagatcactgcccaggaccatcttcccgagaagcatcccttagcctaaaatccacaccaaagggagagttccagaggaatccatgaagaattcccatgcccaggctccatgtgtcatgtggaaacctccacaggtctgctagtgaagaatgcatgtatgtgagatttttgttttctttccaatagcaaattcaaagcaagcaacttgcaggctccatggaacttttaatgaaggacagtgtcttctttgaagaaaatcaagctcgtgtttttattcgaagctctggtgtaaaatatttcaaagtcatagaaatagtttgagaaatgcatagcattatttaacactattgaacagccgactttgagcattgtttcttctaactgcccctcaactaccattatcttcaagtcaacatgcatattacattttcatcctttgctttgcaagcactggtggcttgcagtttgctaatttatttatcatagagtcatcaatgtatttgttgctgacatggttttattagatactgtagtgattcaaataagttttctatttgaaaaaaaaaatcacttgattgtatccttgcccagtgaagccatcctaagacttagcaatatggattgtacatttggctgcatgagcaagtcggccgcacacttccagacagtgtgctgtttgaattgactatttgcactcaaagtctgggtattcattggttattggcctgaaatgatcaaataactacaaatgatctgttgaataaaaatagttgagctgatatatgttaagcagatattcaatcagaatgaacaggttccggtggttattttgccgtttgacattttttatggttcatttatttttaatatagagaggaagattgaatatttatctagagaatacaaagacccacatgtaaatgataggtattatctccatgtatatatgtacccacttagtcatgtaagtgcatatacacatacacacacatgagtgtagacatgtgtttattaattgacaatgacccaaatctcttccacaagacttaaaaccaaattcagggacaaatggatagagaagaaaagggtcaaacatcgagattacatggatgttaaattatatggagacgctaagaaataattgatggagccattgatgcaaaccgaagtagatttagaacttatatgaatttgatttatattttgcaagatcaaaaattagatgttaagtatcagattttaagcttgttttaatggtcaaaaaattaggacagaaataatatggacatttattagtatcttccataatttttaagtctgacacatttctattttattctaacataaaaaaacttccattatatatttactaagtatatttaattcacttaactctgtctttataagttcctattttagatggaataagagaaacaaattatatcaaggtaaaactgatcaaaagcataattgaaagttctgaaaaaagaaaaataataatatgtagaaaaatgtaacttagagagtaacacatgaacattgaagttaaaacccagaagccagatgctcacagttttattttactttaaaataaacctgtctgactgtagctttgtgaaatatcttaaaacgcaaaaaccaattgtgtcctgaaaattgtttcaagaatttaatatttttatgaaaattattttatttaactttaagcaataactagagattacaattaaattttaatcaaaatgaaggcttagttcaaacataaggaaacagtgtttgattaaaaaaaacacatctagtaagacgtaaggggaaaatcacatcctctttggagatgattatattttgatctgaagggtttggggtgttcattagacacttaataaaacttaacttccaatgaaaaagaaatcttttgtaaatcattctacttttgcactttgaaagaaaggcgttaatcataaagaagcaagaatggtcaaaatcgaatgctgcatttttataaacaaaattacagactgtctgaaattgaagaagaatgaactaataatagcattcataaccaaacacaatgatgattattgcagaacattgtatcacattttagtccagagatagaataaagttgaataaccttgacttacacaaaactgttttggtagttggatttcattatcttagtgaatttagtcattttacaatatgtttgtatttggccatttactgtaatcacatttttatatctgtacaatgacactttttgcagttgtggggtagtgtgtaacactgtccatcttgcatcattgaaactactacaatgatactatcatttaataatattaatattacttgaaatagactaagataaagaaaaggggtctgtatgatgtgcagttttgtgcctttatgtatttgccttgttctttgtcgaatgtgtgaaattccgtactgtggtttttcctataatagaaagtagagctgtgtattaaattagactgtgtctctctgatacctttacactactgagaatagcatggttttggccatgtaaaccaattttcaaagttctaatgacatagccatgtgtttttggttttttatatttcattttaaaatttgagtatcaccatacattaattaatactcctgtagtagataagctgtcattaagtaattcccaaaaaaagggccatttgcttgcattactttgaatttaatgttgcgcttgtgcactgtgttaatattgtttgtgatggattggacgttgtgactcttgccttttaagaagaaaaaaaagataggacaaagtatttgaagctcttaaaatgtacatattttggttcttctatctcaaattatttaaaatgcataattcacatttttgtaataattctatgcaattttgtggcatgatgtttcttccacttgtaattttatgtgctttcatcacaaatccaaaggaaagaataaaaatttcttaacacaa

SEQ ID NO: 22452 - DNA, 4616 bp, Homo sapiens
acaggcccccatggcaggcagggcgggtgggaggagggtgatttacaaggcagatgggcctctggctacagctcagtcctgcactcagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagcgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggatactggtggggaggctgagggcagcagcccacccagtgcccctgcaggtgagggcacagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtgtt

SEQ ID NO: 22453 - DNA, 4517 bp, Homo sapiens
cagccagggccaccccaggggctataagagcaactagatttctggagcagctcggggatgggtgccatttgagcccagcttggctccccctcctggctggcctccttcctgcccttctgcctgcctgtgtctgctgagattctgcaaagaggaacgcttggcaccatgtctctgctcaaccctgtcctgctgccccccaaggtgaaggcctatctgagccaaggggagcgcttcatcaaatgggatgatgaaactacagttgcctctccagttatcctccgtgtggatcctaagggctactacttatactggacgtatcaaagtaaggagatggagtttctggatatcaccagcatccgggatactcgctttgggaagtttgccaagatgcccaagagccagaagctccgggacgtcttcaacatggactttcctgataacagtttcctgctgaagacactcacggtggtgtccggcccggacatggtggacctcaccttccacaacttcgtctcctacaaggagaacgtgggcaaggcctgggctgaggacgtactggccctagtcaaacatccgctgacggccaacgcctcccgcagcaccttcctggacaagatccttgtgaagctcaagatgcagctcaactctgaagggaagattccggtgaagaactttttccagatgtttcctgctgaccgcaagcgggtggaagctgctctcagtgcctgccacctccccaaaggcaaaaatgacgccatcaatcctgaggacttcccagaacctgtctacaagagtttcctcatgagcctctgtcctcggccagaaatagatgagatcttcacttcttaccatgctaaggccaaaccctacatgacgaaggagcacctgaccaaattcatcaaccagaaacagcgggactcccggcttaactccctgctgttcccgccagcacggcctgaccaggtgcagggcctcatcgacaagtatgagcccagtggcatcaatgcacagaggggccagctgtcacctgaaggcatggtctggtttctctgtgggccagagaacagcgtgctggcccaggacaagctgctgctccaccacgacatgacgcagccactcaatcattacttcatcaactcgtcccacaacacctacctgacagccggccagttctcaggcctctcctcggctgagatgtaccgccaggtgctgctctctggctgccgttgcgtggagctagactgctggaaggggaaaccccctgacgaggagcccattatcacccatggcttcaccatgaccacagacatcttcttcaaagaagcaattgaggctattgcagaaagcgcctttaagacctccccctatcccatcatcctgtcgtttgagaaccatgtggactcaccccgccagcaggctaagatggctgagtattgccggacgatctttggggatatgctgctcacagagcccctggaaaagttcccactaaaaccaggtgtccccctgcccagccctgaggatctcaggggcaagatcctcatcaagaacaagaagaaccagttttctggccccacctcctccagtaaggatactggtggggaggctgagggcagcagcccacccagtgcccctgcagtgtgggctggcgaggaagggactgagctggaggaggaggaggtggaagaggaagaggaggaggagtcaggaaacctggatgaagaagagattaagaagatgcagtcggatgagggcacagcgggcctggaagtgacggcttatgaggagatgtccagcctagtcaattacatccagcccaccaagttcgtctcctttgagttctctgcccaaaagaaccgaagttatgtcatctcgtccttcacagagctcaaggcatatgacctgctctccaaggcctcggtgcagtttgtggactacaacaagcgccagatgagccgcatttaccccaagggaacccgcatggactcctccaactacatgccccagatgttctggaatgctggatgccagatggttgccctcaacttccagacgatggacttgcccatgcagcagaacatggcagtatttgagttcaacgggcagagcggctacctcctcaagcatgagttcatgcgccggccggacaagcagttcaaccccttctcagtggaccgcatcgacgtggtggtggccaccaccctttccattacggtgatctctgggcagttcctgtcagaacgcagcgtgcgcacctatgtagaagtggagctgtttggccttcctggggaccccaagaggcgctatcgaactaagctgtcacccagtactaactccatcaatcctgtctggaaggaggagccctttgtctttgagaagatcttgatgcctgagctggcctccctcagagtggctgtgatggaggaaggcaacaagtttcttggacaccgcatcatccccatcaatgccctaaattctgggtaccaccacctgtgcctgcacagtgagagcaacatgcccctcaccatgcctgcgctcttcatcttcctggagatgaaggactacatacctggtgcttgggcagatctcactgtggccctcgccaaccccattaagttcttcagtgcccatgacacgaagtctgtgaagctcaaggaggccatgggaggtctgcctgagaagcccttcccactggcgagtccagttgccagccaggtcaatggggcgttggccccaacgagcaatgggtcaccagcagccagggccggggccagggaagaggctatgaaagaagctgcggagccgcggaccgccagcctggaggagctccgggagctaaagggcgtggtgaagctgcagcggcggcacgagaaggagctgcgagagttggagcggcgcggagcgcggcgctgggaggagctgctgcagcggggcgcggcgcagctggcggagctcgggccaccgggcgtggggggcgtcggggcctgcaagctcggtcccggcaagggctctcgcaagaagaggagcctgccccgcgaggagagcgccggagccgcgccgggcgagggccctgagggcgtggacgggcgcgtgcgggagctgaaagacaggctggagctggagctgctgcggcagggcgaggagcagtacgagtgcgttctgaagcgcaaggagcagcacgtggccgagcaaatctccaaaatgatggagctggccagagagaaacaggcggcagagctgaaggccctgaaggagacgtcggagaacgacaccaaagagatgaagaaaaagctggagacaaagagactggagcggatccagggcatgaccaaagtcaccacagacaagatggcccaggagaggttgaagagagagattaacaactcccacatccaggaagtagtgcaggtgatcaagcagatgacggagaacttggagaggcaccaggagaagctggaggagaagcaggcggcttgcctggaacagatacgggagatggaaaagcagttccagaaggaggcgctggcagagtacgaggccaggatgaagggtctggaggcagaggtgaaggagtcggtgagggcctgcctcaggacctgctttccctccgaggccaaggacaagcctgagagggcctgcgagtgccccccagagctgtgtgagcaggacccactcatagcaaaggcagatgcccaggagagccgcctctgatgcccccatcccactgggacatttagcaaggaggttcagccccttctctgggatgtggttctattcccccaggaaaaaggagccccagccttctgaggctgtgggaacctgtggctgccttggacgctgcagccccctcctcaacggccaggccagagtctgagacaggacccaggcaccctcacggcagggcctctctggggcctagaagtcttctcaagctgacttcctacctccccctccatctctagataagtgtcatatatttgttgagggcaaaagactatggactggaaggcagaaagtgggatcctggccccactctgcctttcctattgagcaaccagctctgggctcagtttcctcacctggagggttggacccactcacctccactctagccccgaaccctcctgccccaggcttccaggccccatcaggcctgccctgagttggccttgtccactccttgaggcagatcctggcactacctcacagctccctggggacggccactccctggctgagggccctcccctcccctctgcctgtccggaacgggaggctgaaatggaaaagctgccttggccctgcttggctgagtcacaaggggcagtgggctcttgggtgctgttccaccctgaccctggctcacccctcttcctaggcctgggggcaggcagttcctaccatgtacccctctcaggctgcctgcctgacaaggtcagcatcatttgctctcctgaatttatgaggtttatttatttttctctttcctactcctattaaagaacctcgtcccagtg

SEQ ID NO: 22454 - DNA, 4197 bp, Homo sapiens
ccgggacagactggcgggcgggcgggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccagtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgaggtggccacagggccagggcgggcgctgggtggagggcaggaggcaatgacactaatgctttttttttttttttttaactttttatctagaaattttatttttttaaacccggggcaagtacctcagctaactcccttcatcctcctggggcccctccttcctgccctcagtcttaggttagggccttggtcagggctttgctccctgtgacacccacaccctcgagctagcagcgtctcctcccttccccgggagagctggctggagacttggagctccgggaagtaggagtcacatttttttctctattctttggggattttttttacatgaataaaagtggatttcagg

SEQ ID NO: 22455 - DNA, 4469 bp, Homo sapiens
ggcactgacgccgcggggccggagcgggccgcgcggtgggagcagcggcgccgtcggtccccgtcagggctccgtgggtccccgacccgcccctggccgggccatggcgggcgcccagcccggcgtccacgcgctgcagttggagccgcccaccgtggtggagaccctgcggcgcgggagtaagttcatcaaatgggacgaggagacctccagtcggaacctggtgaccctgcgtgtggaccccaatggcttcttcttgtactggacgggccccaacatggaggtggacacactggacatcagttccatcagggacacacggacaggccggtacgcccgcctgcccaaggaccccaagatccgggaagttctgggctttgggggtcccgatgcccggctggaggagaagctgatgacggtggtgtctgggccagacccagtgaacacagtgttcttgaacttcatggccgtgcaggatgacacagccaaggtctggtctgaggagctattcaagctggctatgaacatcctggctcagaacgcctcccggaacaccttcctgcgcaaagcatacacgaagctgaagctgcaggtgaaccaggatggtcggatccccgtcaagaacatcctgaagatgttctcagcagacaagaagcgggtggagactgcgctggaatcctgtggcctcaaattcaaccggagtgagtccatccggcctgatgagttttccttggaaatctttgagcggttcctgaacaagctgtgtctgcggccggacattgacaagatcctgctggagataggcgccaagggcaagccatacctgacgctggagcagctcatggacttcatcaaccagaagcaacgcgacccgagactcaacgaagtgctgtacccgcccctgcggccctcccaggcccggctgctcatcgaaaagtatgagcccaaccagcagtttctggagcgagaccagatgtccatggagggctttagccgctacctgggaggcgaggagaatggcatcctgcccctggaagccctggatctgagcacggacatgacccagccactgagtgcctacttcatcaactcctcgcataacacctatctcactgcggggcagctggctgggacctcgtcggtggagatgtaccgccaggcactactatggggctgccgctgcgtggagctggacgtgtggaagggacggccgcctgaggaggaacccttcattacccacggcttcaccatgaccacagaggtgcctctgcgcgacgtgctggaggccattgccgagactgccttcaagacctcgccctaccccgtcatcctctccttcgagaaccatgtggactcggcaaagcaacaggcaaagatggctgagtactgccgctccatctttggagacgcgctactcatcgagcctctggacaagtacccgctggccccaggcgttcccctgcccagcccccaggacctgatgggccgtatcctggtgaagaacaagaagcggcaccgacccagcgcaggtggcccagacagcgccgggcgcaagcggcccctggagcagagcaattctgccctgagcgagagctccgcggccaccgagccctcctccccgcagctggggtctcccagctctgacagctgcccaggcctgagcaatggggaggaggtagggcttgagaagcccagcctggagcctcagaagtctctgggtgacgagggcctgaaccgaggcccctatgttcttggacctgctgaccgtgaggatgaggaggaagatgaggaagaggaggaacagacagaccccaaaaagccaactacagatgagggcacagccagcagcgaggtgaatgccactgaggagatgtccacgcttgtcaactacatcgaacctgtcaagttcaagtcctttgaggctgctcgaaagaggaacaaatgcttcgagatgtcgtcctttgtggagaccaaggccatggagcaactgaccaagagccccatggagtttgtggaatacaacaagcagcagctcagccgcatctaccccaagggcacccgcgtggactcctccaactacatgccccagctcttctggaacgtagggtgccagcttgttgcgctcaacttccagaccctcgatgtggcgatgcagctcaacgcgggcgtttttgagtacaacgggcgcagcgggtacctgctcaagccggagttcatgcggcggccggacaagtccttcgaccccttcactgaggtcatcgtggatggcatcgtggccaatgccttgcgggtcaaggtgatctcagggcagttcctgtccgacaggaaggtgggcatctacgtggaggtggacatgtttggcctccctgttgatacgcggcgcaagtaccgcacccggacctctcaggggaactcgttcaaccccgtgtgggacgaagagcccttcgacttccccaaggtggtgctgcccacgctggcttcacttcgcattgcagcctttgaggaggggggtaaattcgtagggcaccggatcctgcctgtctctgccatccgctccggataccactacgtctgcctgcggaacgaggccaaccaaccgctgtgcctgccggccctgctcatctacaccgaagcctcggactacattcctgacgaccaccaggactatgcggaggccctgatcaaccccattaagcacgtcagcctgatggaccagagggcccggcagctggccgccctcattggggagagtgaggctcaggctggccaagagacgtgccaggacacccagtctcagcagctggggtctcagccgtcctcaaaccccacccccagcccactggatgcctccccccgccggccccctggccccaccacctcccctgccagcacctccctcagcagcccagggcagcgtgatgatctcatcgccagcatcctctcagaggtggcccccaccccgctggatgagctccgaggtcacaaggctctggtcaagctccggagccggcaagagcgagacctgcgggagctgcgcaagaagcatcagcggaaggcagtcaccctcacccgccgcctgctggatggcctggctcaggcacaggctgagggcaggtgccggctgcggccaggtgccctaggtggggccgctgatgtggaggacacgaaggagggggaggacgaggcaaagcggtatcaggagttccagaacagacaggtgcagagcctgctggagctgcgggaggcccaggtggacgcagaggcccagcggaggctggaacacctgagacaggctctgcagcggctcagggaggtcgtccttgatgcaaacacaactcagttcaagaggctgaaagagatgaacgagagggagaagaaggagctgcagaagatcctggacagaaagcgccataacagcatctcggaggccaagatgagggacaagcataagaaggaggcggaactgacggagattaaccgtcggcacatcactgagtcagtcaactccatccgtcggctggaggaggcccagaagcagcggcatgaccgtcttgtggctgggcagcagcaggtcctgcaacagctggcagaagaggagcccaagctgctggcccagctggcccaggagtgtcaggagcagcgggcgaggctcccccaggagatccgccggagcctgctgggcgagatgccggaggggctgggggacgggcctctggtggcctgtgccagcaacggtcacgcacccgggagcagcgggcacctgtcgggcgctgactcggagagccaggaggagaacacgcagctctgaactggctgagcgagatgaggagactgaggcccggagccatctgtcgtgtgctaggccacagctaagtcaagacgtcctgacctggaggcagggcaggcctggaccctccgtggtggactgtcttcagccagcctggacctgtcccatgcctcaagaccagcgaaaagtggcagagagcccacagtgcgggctccagggcggggctgggctcgcagcagggtcggcttggcacctcttcaaggcctctcccagcttcctggctcttcccaggctgcccgcctgcatccctcctccaggggaaggcggcctcttatctgggcttatctcctgccaattgagtatcttctttgctttgtttttgctgcagcctcaggcaaacagatggggtggggaggccagggaaacaggctccggagtagggccctcctccctcagggtcaatgcaatggccccagacttcctcacttcttctgtgggacgctgccctatcccccagttctgctcactccagtgtattccgtatctaggctcctcagcagccaactcccaccttcctgactctagctggtgtccactgagggacacactccaagtcagttcccaggtcctcaaataccagctgaatgtctaacttctgggtgtgacattccagcccctagaa

SEQ ID NO: 22456 - DNA, 5430 bp, Homo sapiens
aggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttc

SEQ ID NO: 22457 - DNA, 5620 bp, Homo sapiens
agtaagtgagctgcaccgccaacaagatctctcacacacagacacacacacgcacacgcacacacgggcgcgcacacacacgcgcgtacacactgggtctccaggcagcggccgtcgccgcatccccggcagcagctccaggcaaagtgacagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttc

SEQ ID NO: 22458 - DNA, 5619 bp, Homo sapiens
agtaagtgagctgcaccgccaacaagatctctcacacacagacacacacacgcacacgcacacacgggcgcgcacacacacgcgcgtacacactgggtctccaggcagcggccgtcgccgcatccccggcagcagctccaggcaaagtgacagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttc

SEQ ID NO: 22459 - DNA, 5796 bp, Homo sapiens
gtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgttacctgctattgtcagttcatattgcactcaaaccttgcattatcccttattatgaagaaaaattaatagccaattaaagtaactcagtgtcttcca

SEQ ID NO: 22460 - DNA, 5833 bp, Homo sapiens
gtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctacatggtggctgaaaatccagaagtaactaagcaatgggtagaaggcctgagatcaatcatacacaacttcagggccaacaacgtcagtccaatgacatgcctcaagaaacactggatgaaattggcatttatgaccaacacaaatggtaaaattccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcagcttttgaaatcctgtcatgcagtgtcccaaacgcaaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgttacctgctattgtcagttcatattgcactcaaaccttgcattatcccttattatgaagaaaaattaatagccaattaaagtaactcagtgtcttcca

SEQ ID NO: 22461 - DNA, 614 bp, Homo sapiens
gggaggaggaagcggctggccgctgaggggcggcggggcccggagcgggggacgcgcagggcccggcggtgggcgggcgggtcggcgctgccccgtgggctcgctggggagccacggcggagacccccgccctcaactgaggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagttttacctac

SEQ ID NO: 22462 - DNA, 5325 bp, Homo sapiens
ccagttaggagtattactagaacatttgcatcgggaaaaacagaaaaggtgatctttcaagcactcaaggagttaggtcttcccagtggaaagaatgatgaaattgagcccacagcattttcttatgaaaagttctatgaactgacacaaaagatttgtcctcggacagatatagaagatcttttcaaaaaaatcaatggagacaaaactgattatttaacggtagaccaattagtgagctttctaaatgaacatcaacgagatcctcgattgaatgaaattttatttccattttatgatgccaaaagggcaatgcagatcattgagatgtatgaacctgatgaagatttgaagaaaaaaggccttatatcaagtgatgggttttgcagatatctgatgtcagatgaaaacgccccagtcttcctagatcgtttagaactttaccaagaaatggaccatcctctggctcactacttcatcagttcttcccataacacttatctcactggcagacagttcggcgggaagtcttcggtagaaatgtacagacaggttctcctggctggttgcagatgtgttgaacttgactgctgggatggaaaaggtgaagaccaagaaccaataataactcatggaaaagcaatgtgtacagatatcctttttaaggatgtaattcaagccatcaaggaaactgcatttgtcacatcagaatatcctgtaattctctcctttgaaaatcactgcagcaaatatcaacagtacaagatgtccaaatattgcgaagatctatttggggatctcctgttgaaacaagcacttgaatcacatccacttgaaccaggcagggctttgccatcccccaatgacctcaaaagaaaaatactcataaaaaacaagcggctgaaacctgaagttgaaaaaaaacagctggaagctttgagaagcatgatggaagctggagaatctgcctccccagcaaacatcttagaggacgataatgaagaggagatcgaaagtgctgaccaagaggaggaagctcaccccgaattcaaatttggaaatgaactttctgctgatgacttgggtcacaaggaagctgttgcaaatagcgtcaagaaggcttcagatgaccttgaacatgaaaacaacaaaaagggcctggtcactgtagaagatgagcaggcgtggatggcatcttataaatatgtaggtgctaccactaatatccatccatatttgtccacaatgatcaactacgcccagcctgtaaagtttcaaggtttccatgtggcagaagaacgcaatattcattataacatgtcttcttttaatgaatcagtcggtcttggctacttgaagacacatgcaattgaatttgtcaattataacaaacggcaaatgagtcgcatttaccccaagggaggccgagtcgattccagtaattacatgcctcagattttctggaacgctggctgccagatggtttcactgaactatcaaaccccagatttagcgatgcaattgaatcagggaaaatttgagtataatggatcgtgcgggtaccttctcaaaccagatttcatgaggcggcctgatcgaacatttgaccccttctctgaaactcctgttgatggtgttattgcagccacttgctcagtgcaggttatatcaggtcaattcttatcagataagaaaattggcacctacgtagaggtggatatgtatgggttgcccactgacaccatacgtaaggaattccgaactcgcatggttatgaataatggactcaatccagtttacaatgaagagtcatttgtatttcggaaggtgatcctgccggacctggctgtcttgagaatagctgtgtatgatgataacaacaagctgattggccagaggatcctcccgcttgatggcctccaagccggatatcgacacatttcccttcgaaatgagggaaataaaccattatcactaccaacaattttctgcaatattgttcttaaaacatatgtgcctgatggatttggagatatcgtggatgctttatcagatccaaagaaatttctctcaattacagaaaagagagcagaccaaatgagagctatgggcattgaaactagtgacatagccgacgtgcccagtgacacttccaaaaatgacaagaaaggaaaggccaacaccgccaaagcaaatgtgacccctcagagtagctctgagctcagaccaaccaccacggctgccctggcctctggtgtggaagccaagaaaggtattgaacttatccctcaagtaaggatagaagacttaaagcagatgaaggcttacttgaagcatttaaagaaacagcagaaggagctaaattctttaaagaagaaacatgcaaaggaacacagtaccatgcagaagttacactgcacgcaagttgacaaaattgtggcacagtatgacaaagagaagtcgactcatgagaaaatcctagagaaggcaatgaagaagaaggggggaagtaattgtctcgaaatgaaaaaagaaacagaaatcaaaattcagacgctgacatcagatcacaaatctaaggtcaaagagattgtagcacagcacacaaaggaatggtcagaaatgatcaatacccacagtgctgaggagcaagaaatccgagacctgcacctcagccagcagtgtgagctgctgaaaaagctactcatcaatgcccacgagcagcaaacccagcagctgaaactgtcccatgacagggaaagcaaggaaatgcgagcacaccaggctaagatttctatggaaaatagcaaagccatcagccaagataaatctatcaagaataaagcagaacgggaaaggcgagtcagggagttaaacagcagcaacactaaaaagtttctggaagaaagaaagagacttgccatgaagcagtccaaagaaatggatcagttgaaaaaagtccagcttgaacatctagaattcctagagaaacagaatgagcaggcgaaggagatgcagcagatggtgaaattggaagccgagatggaccgcagaccagcaacagtagtatgaaactccaaaatgcaaactgaagcagcaaacccacaaagcatcaaaagactcactcacaaacttctgaacacaaactccatggatgaaagctgtttattttgtttcctttatgtgtaaacaagatgatatctgaaaccagagagacttggaatgtctgactgacttctatttaacagcttgagtattgcatttccttggccaaacaaaaatagctacaaatccacaaaaatttactattccagtaaggcagagtccaaccattgataatacaacttaaacatgtttgctataaaataccatcacaagtaaatgagcttggtgtgaacaactctcctttgtgatgccttaggacatgtttgaactgcagcaaaaaacaaaaacaaaaaacagtgcattagcaatttcatagcaagtgcatgcactaggaaaagaaaactctgtctacaagtttattagcagaagtggtggtctgctagacaaataattttgcaaaatttttctacatctaagttacctcatcagtaagtgccatgtctctaccatgccatcagaggctaatttcctgtaaaagttgtggaaattgttagaacaatagaaaaatagagcagtgtatgtgtgccaaaactcatcattactcaaaggagaactgtgttaggcacatttaagaaagtttacatctgacattgctttataggaattgtttctgcagattccggatattataattcacaccataaagattgtgaagtggttattggcaaacgtttgtaaatgtgaccatgtataaagtatttatactctttaattcacactgttagagagcaaaatcatctaagtattgccacatgacaagattagtaaacaggaatactagaactatgtttgcatgatacacaagcaccaataaagactaatccatacacagttaacctaatgccaaataaatactggttaaataaatgtatggcacagaatataatttgactatcaagacttttagcataatgaaaaaccctctctctatatatatatgtgtatatgaattatgtgggcattcttgatacttcaagttctagtttgaaaaaaatacataactaatttaattttacacaaaaatatttatgcagattttcagaatttcatatcaggaaatgacctttttatgtctgttaaatatcaaaacaatttgctacagtgttaatctgcatggtctttaagcctgctgtagttgagttgcagacagtgcatgaaaaagtattccgctgggaattgagccatgccaccaaagccaagaggagcgcatggaaacccggtagtctagaactaatcagattactgattttagggcacagcaccagatgaattgttgtatatgcttgtaaaaattgattctgtgtgttcctctgaacaaagcggagaaaatgatgataccatcaatattgaaattaaacttccaacttctctaataaaaaattaaaacacgcataacactcgtcaagagtatttgctcccaagacacattctagcaaatgttttgcctttttcatatacatgatatcatcgttattttcaaagggggcttattaataccctcagcatgtttttcacccaaatgatgcaaaacatgcagattctagttgacttcagttgtaatagacttgtttttctcctatttatgatttgaagtggattctgtaaaatatctcttgttcttagtttccttatctgtaaaacagtggagttagactacatatcttttggcactaacatctcatgaaaaattatggttaataaaatatcaccacatttggattgccaattttcaaagattctgagtggcttctcatcatcaaatcaaatcaaatccaagagctcaactatgctcaccattctgtaacacttgactgaattcatcacttgcctcctcttgtttctgctttggagaggtactactagtttttccatttttcttatttcttccctcttttcatcctcctaggccaccataagcatttatattttccagtgttatacatggaaccagtttgtttttctttgatccaggttacttttagtatttgagacatcataccattaatccattgtagtaggattaaaatgtacacacaactcaaatgtgcaacaaaagcatgtgttacctgctattgtcagttcatattgcactcaaaccttgcattatcccttattatgaagaaaaattaatagccaattaaagtaactcagtgtcttcca

SEQ ID NO: 22463 - DNA, 595 bp, Homo sapiens
ctgtgacaagcgtttgctgtatttgttgttcgacttagggtagttgaaagagtctctctcagccactctctctggatattttgttgtggctgtgggcactgtttgcccagcctctcactttgtagcggaggggtgggactctgcgtgaaaggaccagcgttatagtccctggcttctccggctaattcatcccgaggctcctgccccttcccattctggaaggggcgagcttatcctagacctgtgactgcctctgaagttctccacctgcctcaggcgtgctctccagtgcctgtttctgactgagtgaggttgaaatcctactgactccttttcagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgct

SEQ ID NO: 22464 - DNA, 484 bp, Homo sapiens
acacgcacacgcacacacgggcgcgcacacacacgcgcgtacacactgggtctccaggcagcggccgtcgccgcatccccggcagcagctccaggcaaagtgacaggaaaagacaatttctctctgattcagaatcctgaaaatgtgatctcccttaaaaagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctg

SEQ ID NO: 22465 - DNA, 505 bp, Homo sapiens
gcgggggacgcgcagggcccggcggtgggcgggcgggtcggcgctgccccgtgggctcgctggggagccacggcggagacccccgccctcaactgagaggacagtgctgctgtgagtttgacgaagtggacatcacctgcagtcagtccagagctgcccagtcttgaatataatcatggccaaaccttatgaatttaactggcagaaggaagttccctcctttttgcaagaaggagcagtttttgacagatacgaggaggaatcctttgtgtttgaacccaactgcctcttcaaagtggatgagtttggcttctttctgacatggagaagtgaaggcaaggaaggacaggtgctagaatgctccctcatcaacagtattcggtcgggagccataccaaaggatcccaaaatcttggctgctcttgaagctgttggaaaatcagaaaatgatctggaagggcggatagtttgtgtctgcagtggcacagatctagtgaacattagt

SEQ ID NO: 22466 - DNA, 2769 bp, Homo sapiens
cgcgtccccagaagggggcggggagagacgagggttggcgggctcagggggcgggggcgcagggcagcgggggcggggcggtgtcccgggaccacccccggcctcctcccaccgcggtccattcaggtccctgcaccgcactccgctcggaccccaggccgccggtgctgtcgctactcaagtgagtcccgcggtgcccctcccgccgcgccgcccgtcgggcatggactcgggccgggacttcctgaccctgcacggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggaggcggcagggcctgcgctggccctctccctcattgagcgctacgagcccagcgagactgccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagatt

SEQ ID NO: 22467 - DNA, 2963 bp, Homo sapiens
ttcttctcgtcccgcctcctgtattctgactccccccactcatttactttgcctcggtttcgctctcgcctcaccttcagggggcataggtcccgccgctcgtggactagctccgcctcctagcgtctgactaccccctcagcccagatttccctctcgtcccgcccctccgaagtgcgcccctcctctcgaactctagctcctccctcccattcctggactccgcccctgctcccctccaagggcgacagttccgccccccggaccagagcagagggtgttgtgagcataaaacactggaggcggcactgccccggacccggctccgcgcaggcaggggcactgtggagggccatgcagtgcctggggatccggagccggagccgctccagggagctctacctgcaggagcggagccttaaggtggcggcgctcaatggacggaggctgggcctacaggatgatgaggatctacaggcgctgctgaagggcagccagctcctgaaggtgaagtccagctcatggaggagagagcgcttctacaagttgcaggaggactgcaagaccatctggcaggagtcccgcaaggtcatgcggaccccggagtcccagctgttctccatcgaggacattcaggaggtgcgaatggggcaccgcacggagggtctggagaagttcgcccgtgatgtgcccgaggaccgctgcttctccattgtcttcaaggaccagcgcaatacactagacctcatcgccccatcgccagctgatgcccagcactgggtgctggggctgcacaagatcatccaccactcaggctccatggaccagcgtcagaagctacagcactggattcactcctgcttgcgaaaagctgacaaaaacaaggacaacaagatgagcttcaaggagctgcagaacttcctgaaggagctcaacatccaggtggacgacagctatgcccggaagatcttcagggagtgtgaccactcccagacagactccctggaggacgaggagattgaggccttctacaagatgctgacccagcgggtggagatcgaccgcaccttcgccgaggccgcgggctcaggggagactctgtcggtggatcagttagtgacgttcctgcagcaccagcagcgggaggaggcggcagggcctgcgctggccctctccctcattgagcgctacgagcccagcgagactgccaaggcgcagcggcagatgaccaaggacggcttcctcatgtacttactgtcggctgacggcagcgccttcagcctggcacaccgccgtgtctaccaggacatgggccagccacttagccactacctggtgtcctcttcacacaacacctacctgctggaggaccagctagccgggcccagcagcactgaagcctacatccgggcactgtgcaaaggctgccgatgcctggagcttgactgctgggacgggcccaaccaggaaccaatcatctaccacggctatactttcacttccaagatcctcttctgcgatgtgctcagggccatccgggactatgccttcaaggcgtccccctaccctgtcatcctatccctggagaaccactgcacactggagcagcagcgcgtgatggcgcggcacctgcatgccatcctgggccccatgctgttgaaccgaccactggatggggtcaccaacagcctgccctcccctgagcaactgaaggggaagatcctgctgaaggggaagaagctcggggggctcctgccccctggaggggagggtggccctgaggccactgtggtgtcagacgaagacgaggctgctgagatggaggatgaggcagtgaggagccgtgtgcagcacaagcccaaggaggacaagctcaggctagcacaggagctctctgacatggtcatttactgcaagagtgtccactttgggggcttctccagtcctggcacccctggacaggccttctacgagatggcgtccttctctgagaaccgtgcccttcgactgctccaagaatcaggaaacggctttgtccgccacaacgtggggcacctgagcagaatctacccggctggatggagaacagactcctccaactacagccccgtggagatgtggaatgggggctgccagatcgtggccctgaatttccagacacctgggccagagatggacgtgtaccagggccgcttccaggacaacggggcctgtgggtacgtgctgaagcccgccttcctgcgagaccccaacggcacctttaacccccgcgccctggctcaggggccctggtgggcacggaagcggctcaacatcagggtcatttcggggcagcagctgccaaaagtcaacaagaataagaattcaattgtggaccccaaagtgacagtggagatccatggcgtgagccgggacgtggccagccgccagactgctgtcatcaccaacaatggtttcaacccatggtgggacacggagtttgcgtttgaggtagttgtgcctgaccttgccctcatccgcttcttggtggaagattatgatgcctcctccaagaatgacttcattggccagagtaccatccccttgaacagcctcaagcaaggataccgccatgtccacctcatgtctaagaacggggaccagcatccatcagccaccctctttgtgaagatctccctccaggactaggctggaggaagccagtggggtcccccctgagtgggctgggccctctgtccacatgtggggacagggctggtgtggctgctcccagcctcttgctcagagctaggcccccaaattgccttcagccctaacatagtgtctgctgctgcctccctggggaccaggagctagcccagtccctggagctgtccttcattccgttaggaataacactgcagccctctccaccctccggccagcgagtggtcaaggatttttataaaaatcacgataagatt

SEQ ID NO: 22468 - DNA, 7992 bp, Homo sapiens
cgctgggcaacgtgggcaacgcggcgggcggcgggctcgcgcggcgggaggggcagcggcggcgcgcccgggctctacctcccgggctctgcctcccgggctctgcctctcgggcacttgcctggctcctgcgcgttcctgggcatcggctctgcagctgacacacagtagcggggacacccgacgccgctagcgacaggcgcgcggacggctggtcccagagggacgctgcgcttggggacgccggcgagactcgccaggagccaagaggaaacaggaatcattcaaactggattttaaaatcattgcaaatcagtgatggatcagaagttgcagagtgcaatcccgagtaaaagtcttcaaaaaattttgcttcaggtaacagaggaaggaaaattgatctaccaccttaaaaccctgatctagaaaaaatatatattcatgataggaagttataactaagaaaatttatttgcctcttaatgctcctgaatgaaaggaattatccctttgttctttgggaggacttgtgtatctgagattgttgtaataatcagtcattttattaaaaccttgacatgatcaccagggaggaaaaatagagcaatagtcaaaacctgtgtgttagtccaagatgacttctgaagaaatgacagcttctgttctcatacctgtgactcagagaaaagtggtttctgcccagtcggctgcagatgaaagtagtgaaaaggtctcagacatcaatatttcaaaagcacatactgtcagacgaagtggggagacttctcataccatctcacaactgaacaaacttaaagaagaaccttctggaagcaacttgccaaagattctctcaatagcgagggagaaaatagtgagtgatgagaacagtaatgaaaaatgttgggagaaaatcatgccagattctgcgaaaaaccttaacattaactgcaacaacatattgagaaaccatcagcatggccttcctcagagacaattttatgaaatgtacaactctgttgctgaggaagacttgtgtttagaaactggaattccttctccactggaaagaaaggtgttccctggaattcaactggaactagacagaccttccatgggcattagtcctttaggaaatcagtcagtgatcatagagacaggcagagcacaccctgacagcagaagggcagtatttcattttcattatgaagttgacagaagaatgtcagacactttctgtaccctatcagaaaacttaattttagacgattgtggaaattgtgtaccactacctgggggtgaggagaagcaaaagaaaaactatgtggcatatacctgtaaactgatggaattggccaaaaattgtgataataagaatgagcagctgcagtgtgatcattgtgacaccttgaatgataaatacttttgctttgaaggctcttgtgagaaggttgacatggtatattcaggtgatagcttttgtaggaaagactttactgacagtcaagctgccaagacctttttgagccattttgaggacttccctgataattgtgatgatgtagaagaagacgcttttaaaagcaaaaaggagcgatccactttgttagtcaggagattctgtaaaaatgacagagaagttaagaaatctgtgtatactggaacaagagcaattgtgagaactctgccttctggccacattgggctgactgcatggagttacatagatcagaagagaaatggtcccttactgccttgtgggagagtaatggaacccccgtcaacagtggagataaggcaagatgggagccaacgtctgtcagaagcccagtggtatcctatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 22469 - DNA, 6514 bp, Homo sapiens
atggtttcagaaggaagtgcagcaggaagagactttgcaggaatggaagaggtgaggcagctccacgtgagattctgcaaagggattaagatttggcaccaggcttggtttctgtgcagcctcttaggcagagagccccaggagagggaagcaggctgtcagctgtggctttgcacgctctcagctgtcttgaaggttggttggctcttcccgctctctgaggtacccaattttaccttgttaaaggatggatgtggatgctggaggcttaaagaagaccagatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtatagtaagtcattgcaccatcctggaacagggcttaacttaaactactttgtaaggaaggcataattagtacaatgtcttttatcttttccaacaggaggatgtcccttgaaggcaggtaggaatgggaccttaaaacaggaaaagggctctgaagatatgtgtaacatgatatgctattgaacaccgcctataaagaaaaagggaaagaggctgggcgtggtggcgcatgcctgtaatcccagcactttgggaggccaaggcaggcagatcacctgaggtcagttcaagaccagcctgaccaacatggagaaaccccgtctctactaaaaatacaaaattagctgggcatggtggtgcatgcctataatcccagctactggggaggctgaggcaggagaatcacttgaacttggaaggcagaggttgcagtgagctgagatcacaccattgcactccagcctgggcaatgagagtgaaaactccgtctcaaaaaaaaaaaaa

SEQ ID NO: 22470 - DNA, 7563 bp, Homo sapiens
atctaccaccttaaaaccctgatctagaaaaaatatatattcatgataggaagttataactaagaaaatttatttgcctcttaatgctcctgaatgaaaggaattatccctttgttctttgggaggacttgtgtatctgagattgttgtaataatcagtcattttattaaaaccttgacatgatcaccagggaggaaaaatagagcaatagtcaaaacctgtgtgttagtccaagatgacttctgaagaaatgacagcttctgttctcatacctgtgactcagagaaaagtggtttctgcccagtcggctgcagatgaaagtagtgaaaaggtctcagacatcaatatttcaaaagcacatactgtcagacgaagtggggagacttctcataccatctcacaactgaacaaacttaaagaagaaccttctggaagcaacttgccaaagattctctcaatagcgagggagaaaatagtgagtgatgagaacagtaatgaaaaatgttgggagaaaatcatgccagattctgcgaaaaaccttaacattaactgcaacaacatattgagaaaccatcagcatggccttcctcagagacaattttatgaaatgtacaactctgttgctgaggaagacttgtgtttagaaactggaattccttctccactggaaagaaaggtgttccctggaattcaactggaactagacagaccttccatgggcattagtcctttaggaaatcagtcagtgatcatagagacaggcagagcacaccctgacagcagaagggcagtatttcattttcattatgaagttgacagaagaatgtcagacactttctgtaccctatcagaaaacttaattttagacgattgtggaaattgtgtaccactacctgggggtgaggagaagcaaaagaaaaactatgtggcatatacctgtaaactgatggaattggccaaaaattgtgataataagaatgagcagctgcagtgtgatcattgtgacaccttgaatgataaatacttttgctttgaaggctcttgtgagaaggttgacatggtatattcaggtgatagcttttgtaggaaagactttactgacagtcaagctgccaagacctttttgagccattttgaggacttccctgataattgtgatgatgtagaagaagacgcttttaaaagcaaaaaggagcgatccactttgttagtcaggagattctgtaaaaatgacagagaagttaagaaatctgtgtatactggaacaagagcaattgtgagaactctgccttctggccacattgggctgactgcatggagttacatagatcagaagagaaatggtcccttactgccttgtgggagagtaatggaacccccgtcaacagtggagataaggcaagatgggagccaacgtctgtcagaagcccagtggtatcctatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactg

SEQ ID NO: 22471 - DNA, 6456 bp, Homo sapiens
attcagtgggtcgtggtgattaatggtttcagaaggaagtgcagcaggaagagactttgcaggaatggaagaggtgaggcagctccacgtgagattctgcaaagggattaagatttggcaccaggcttggtttctgtgcagcctcttaggcagagagccccaggagagggaagcaggctgtcagctgtggctttgcacgctctcagctgtcttgaaggttggttggctcttcccgctctctgaggtacccaattttaccttgttaaaggatggatgtggatgctggaggcttaaagaagaccagatctacaatgcagtgagaagagaagaaacagaaaatacagttggatctctactccatttcctcaccaagctcccagcctccgagacagcccatggaaggataagcgttggtccatgcttaaagcaatgtgtccgagacactgtatgtgagtatcgcgccaccctccaaaggacttcaatatcgcagtacatcaccggttctctcctagaagcaaccacgtctttgggagcaagaagtggccttctcagtacttttggaggatccactggacgaatgatgctgaaagaacgccagccaggcccctctgtggccaattccaatgccctcccttcaagttcagctgggatcagcaaggagctgatcgatctgcagcctctcatccagttcccagaggaagtcgccagcatcctgatggagcaagagcagactatttaccgcagggtcttgccagtcgactacctttgcttcttaacacgggacttgggcactcctgaatgccagagctccttgccctgcctcaaagcatccatctcagcgtcgattcttaccactcagaatggagagcacaatgcccttgaagatctggtgatgaggtttaatgaggtgagctcctgggtgacatggctgatcctcacggcaggctccatggaggagaagcgagaagtcttttcatatttggtgcatgtggccaaatgctgctggaacatgggcaactacaacgctgtcatggagttcttggctggcctcaggtcaagaaaagttttaaaaatgtggcagttcatggaccagtctgatattgagaccatgaggagcctgaaggatgctatggcccagcatgagtcctcttgtgagtacagaaaggtggtgacacgtgccctgcacatccctggctgtaaggtggttccattctgtggggtgtttctgaaggagctctgtgaagtgcttgacggcgcctccggtctcatgaagctttgcccgcggtacaattcccaagaagaaactttagagtttgtagcagattacagtggacaagataatttcttacaacgagtgggacaaaatggcttaaagaattcggagaaggagtccactgtcaacagcatctttcaggtcatccggagctgcaatcgaagtctggagacagacgaggaggacagccccagtgaaggaaacagctccaggaaaagctccttgaaggataaaagccgatggcagtttataattggagatttgttggattcagacaatgacatctttgagcaatccaaagaatacgactctcatggttcagaggactcacagaaggccttcgaccatgggacggagctcatcccttggtacgtgctgtccatccaagccgatgtgcaccagttcctgctgcagggggccacggtcatccactacgaccaggacacacacctctctgcccgctgcttcctccagcttcagcccgacaatagcaccttgacctgggtaaagcccacaactgcctccccagccagcagtaaagcaaaacttggtgtacttaataacacagctgagcctggaaaattcccactactgggtaatgctggattaagtagcctgacggaaggggtcttggatctttttgcagtgaaggctgtatacatgggccaccctggcattgatatacacactgtgtgtgttcagaacaaactgggtagcatgttcctgtcagagactggtgtgacattgctctatgggcttcagaccacagacaacagattattgcacttcgtggcaccaaagcacacagctaaaatgctcttcagcggattattggaactcactagagctgtgagaaagatgaggaaattccctgaccaaagacagcagtggctgcggaaacagtacgtcagcctttatcaggaggatggacggtatgaaggcccaactttggctcacgctgtggagttgtttggtggcagacggtggagtgctcgaaaccccagccccggaacatcagcaaagaatgctgagaagcccaatatgcagagaaacaataccctgggcataagcactaccaagaaaaagaagaaaatcctcatgaggggtgagagtggagaggtaactgacgatgagatggcaacccgaaaggccaagatgcacaaagagtgtcgaagccggagtggttctgatcctcaagacattaatgaacaagaagaatcagaggtgaatgccatcgctaaccctccaaaccccctcccttccagaagagcccactctttgaccacagctgggtcccccaacttggctgccgggacgtcatctcccatcaggccagtgtcctcccctgtgctgtcttcttcaaacaagagcccatccagtgcttggagcagtagtagctggcacgggcggatcaaaggcggcatgaagggatttcagagcttcatggtttcagatagcaacatgagttttgttgaatttgttgagctgttcaaatcattcagtgtcaggagccgcaaggacctgaaggatctgtttgatgtctatgcagtgccctgcaaccgatctggctccgagtcagccccactctacaccaacctgacaattgatgaaaacaccagcgatcttcagcctgacctagatctgttgaccagaaatgtctcggatttggggttgttcattaagagtaaacagcagctatcggacaaccagaggcagatatctgatgccattgctgctgcaagcattgtgacaaatggcactgggattgagagcacatctctgggcatttttggggtgggcatacttcagctcaacgatttcctcgtgaattgccaaggagaacactgcacttatgatgaaatcctcagcatcatccagaagttcgagcctagcatcagtatgtgtcatcagggactaatgtcatttgaagggtttgccaggtttctgatggataaagaaaattttgcctcaaaaaatgatgagtcacaggagaacattaaagaactgcagctacccctctcatactattacatcgaatcttcgcacaatacctacctcacgggccatcagctcaaaggagaatcctcggtagaactctacagccaggtccttttgcaaggctgtcgaagtgtagaattggactgctgggacggagacgatgggatgcccatcatttatcatggacatacgctgacaaccaagatccccttcaaggaagtggttgaagccattgatcgcagtgccttcatcaactctgacctgccaatcatcatatcgattgagaaccactgttcattgcctcagcaacgaaaaatggcagaaattttcaagactgtgtttggagaaaagctggtgactaaattcttatttgagactgatttctcagatgatccaatgcttccttcacctgaccaactcagaaagaaagttcttcttaaaaacaagaagctaaaagcccatcagacgccagtggatatcttaaagcaaaaggctcatcagttagcatctatgcaagtgcaggcttataatggtgggaatgccaacccccgacctgccaataatgaggaagaggaagatgaggaggacgaatatgattatgactatgaatccctttctgatgacaacattctggaagacagacctgaaaataaatcatgtaatgacaagcttcagtttgaatataatgaagaaatcccaaagaggataaagaaagcagataactctgcttgcaacaaaggaaaggtttatgatatggaactgggagaagaattttatcttgatcagaataaaaaggaaagcagacagattgcaccagagctttctgaccttgtaatctattgtcaagcagtaaaatttccaggactgtcaactctaaatgcatctggctctagcagaggaaaagaaaggaaaagcaggaagtccatttttggcaacaatccgggcagaatgagcccaggggagacagcatcatttaacaaaacatctggaaaaagttcctgtgaaggcattcgacagacctgggaggaatcttcttcccctctcaacccaaccacgtccctcagtgctatcattagaactcccaaatgttatcatatctcgtcgctgaatgaaaatgccgccaaacgtctgtgtcgcaggtattctcagaaactgacccagcacaccgcctgtcagctgctgagaacttaccctgctgccacccgcatcgactcttccaacccgaaccccctcatgttctggctccatgggatacagcttgtggcactcaactaccagactgatgatctccctttacatttaaatgctgcaatgtttgaggcaaatggtggttgtggttatgtattgaaacctccagttctgtgggacaagaactgccccatgtatcagaagttttctccactagaaagagatctggacagcatggatcctgcagtctattctttaactattgtctctggtcagaatgtgtgccccagtaatagcatgggaagcccgtgcattgaagtcgacgtcctgggcatgcctctggacagctgccatttccgcacaaagcccatccatcgaaacaccctgaaccccatgtggaacgagcagtttctgttccacgttcacttcgaagatcttgtatttcttcgttttgcagttgtggaaaacaatagttcagcggtaactgctcagagaatcattccactgaaagctttaaaacgaggatatcgacatcttcagctgcgaaaccttcacaatgaagtcttggagatttctagtttattcattaacagcagaaggatggaagaaaattcctctggcaataccatgtcagcctcttcgatgtttaatacagaagaaagaaaatgtttgcagactcacagagtcacggtgcatggggtcccagggccagagccctttaccgttttcactattaatggaggcaccaaggcaaagcagcttctgcagcaaattctgacaaatgaacaagacatcaaacctgttaccacagactattttttgatggaagaaaaatattttatatctaaagaaaagaatgaatgtaggaaacaaccattccagagagccattggtccagaagaggagatcatgcaaattttaagcagctggtttccagaagagggatacatgggcaggattgtcttaaaaacccagcaggaaaacctagaagagaaaaacattgttcaagatgacaaagaggtgatcttgagctcagaggaggagagtttctttgtccaagtgcatgatgtttctccagagcaacctcgaacagtcatcaaagcaccccgcgtcagcactgcacaggatgtcattcagcagaccttatgcaaagccaaatattcctacagcatcctgagcaaccccaatccaagcgactatgtgcttttggaagaggtggtgaaagacactaccaacaagaagactaccacaccaaagtcctctcagcgggtccttctggatcaggagtgtgtgtttcaagcccaaagcaagtggaaaggtgcaggaaaattcatccttaagctaaaggagcaggtgcaggcatctcgagaagataaaaagaaaggcatttctttcgcaagtgaactcaagaagctcaccaagtcaactaaacagccccgaggacttacatcaccttctcagctcttgacctcagaaagtatccaaaccaaggaggagaaacctgtgggtggcttgtcctccagtgacacaatggattaccgacagtgactaagggcagcatgtttaacccaggtgaagatctttaagcaagaagttaaagagtgaacatggtggaaaaaatataattattttcatcagacttaaactggaaattgatgatttctgaactgaagccttcacacatgtgagatccatgctgaggagaagcaaaatggcacagggctagttgccaccaaccaatttactgatgaatgaagcccaggggactgccattttataaatgtcagcagttggaaaaatcgtcacgaattgacttagagcaagggtcagcaagcttgtctgtaaagggccaaacagtaaatattttagggctgggggccataaaatatgttgcaaccacccaattctgccattgtagtgcaaaagcagccatagacaacacatacatgaacgaacgtggctgtattccaataaaactttatttatggacactgaaa

SEQ ID NO: 22472 - DNA, 6128 bp, Homo sapiens
tggaaaaaaggaactgtgtgcagtaccgcaggcattttctggtggacaacagtgtgtttcatgttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 22473 - DNA, 6168 bp, Homo sapiens
atggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagtggagccctttaatactcaaccccagttatactatattgcactttctaggagctacaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 22474 - DNA, 6385 bp, Homo sapiens
agatgcttccagcgtgcttatctggctgtgcttttcactttgggacaaagttctataatcatatctcatggatttattttctccacactataaagcctgaattgtgaagatctcatcatgccataaagggcagcatgagccaagttctgggggctgctaaggatttctttgccttttttccccccaccctttttggaaatgtgtatcaggaaaaggctttgcctttagagagaaattgtactgctcttgccaataatgtgtaatagtattaaatttaatggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 22475 - DNA, 6196 bp, Homo sapiens
atggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagtggagccctttaatactcaaccccagttatactatattgcactttctaggagctacaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagtacaaatctgaataggaaacaacttaagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaac

SEQ ID NO: 22476 - DNA, 6413 bp, Homo sapiens
gagaaagcaggttgtggcggcggcgccctgctcttccccgctcgtctggggcttctgctggctagtggggagaagtgctcttctaggggggcttttctggcccttggcaggggtttggagttggagtcacaggggccaataactcatcaccccagcacttcggaggtggctccttgtgccacggactccgaggagtccttcagctactgaacactcaaagctgaggagggcaatttggttttgatgctgtgccagaaatcttctgacaatgagttactggaacttggaaaaaaggaactgtgtgcagtaccgcaggcattttctggtggacaacagtgtgtttcatgttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagcagaagataaagatggcagaagaaaagggaaagcaagtataaaagatccacattttctaaatttcaacaaaaagttatcatcctcctccagtgctctgctccacaaagataccagccaaggggacaccattgtatctactgcccacatgtcagtcacaggagaacagctgggcatgtcaagtcctaggggtgggagaaccacatcaaatgccacaagcaattgccaggaaaacccctgtcccagcaagtctctctccccaaagcagcatttggctcccgatcctgtagttaaccccacacaagatctgcatggtgtgaaaatcaaggaaaagggtaatcctgaggactttgtggaagggaaaagcatcttgtcaggaagcgtcctttctcatagcaacctagaaattaagaacctggaaggtaataggggtaagggccgagctgcaacatccttttctttgtcagacgtctccatgctctgttctgacatacctgacctacattcaactgcaattctgcaggagagtgtaatttcccatcttattgacaatgtcactttaacaaatgagaatgagccgggcagttccatctcagccctgattggccagtttgatgagaccaacaatcaggctctcacagttgtttctcatcttcataataccagtgtgatgtcaggccattgtcccttgcctagcctgggcctaaaaatgcccatcaagcatggtttttgcaagggaaaatccaagtcttccttcctgtgctcatctccggagctgatagcactctcgagttctgagaccaccaaacatgcaacgaacacagtttatgaaactacctgcactcccatctctaaaaccaaaccagatgatgacctttctagtaaggccaagacagcggccttagaaagcaacctgcctggatcccctaatacttctcgtggctggttaccaaaaagtcctaccaagggagaagactgggaaacactgaagagctgcagccctgcctcttcccctgatttgaccctggaggatgtaatagctgatcccactctctgtttcaattctggggagagcagccttgtggaaattgatggagaatcagaaaatctttctctaacaacctgtgaatataggagagagggcacaagtcaacttgcttctcctttaaaactcaagtacaatcagggtgtggtagaacactttcaaagaggtttgagaaacggctactgtaaagagaccctccgcccttctgtccctgaaatattcaacaatattcaagatgtcaaaactcaaagtatttcttatctagcctatcagggtgctggctttgtgcataatcatttctcagattcagatgcaaaaatgttccagacctgtgtgccccagcaatctagtgctcaagatatgcatgtccctgtacccaagcagttggcacatcttcctttgcctgctctgaaactgcctagtccttgcaaatccaaaagtctgggggacttaacatcagaggacattgcctgcaattttgagagcaagtaccagtgtattagtaagagttttgttacaactggcattagagacaagaagggcgtgactgtgaagacaaagtcgttagagcctatagatgccctgaccgagcagcttcggaagcttgtgtcctttgaccaggaagacaactgccaagtgctatattcaaagcaggatgccaatcagctcccccgggcactggtcaggaagttgtcatccagaagtcagagcagagtgcgcaatattgctagtcgtgccaaggagaaacaggaagccaacaagcagaaagttccaaaccccagcaatggggcaggagtggttcttagaaacaaaccctcagcacccacccctgcagtgaatcgccactccaccggctcctacatcgcaggctacctgaagaacacgaaagggggtggccttgaaggccggggcatcccagagggggcatgcacggctcttcactatggccacgttgaccagttttgttcagataattctgttttgcagactgagccaagcagtgatgataaaccagaaatttattttcttttgagactgtgaattatttaaaactgcattcttaaggttttcaaggtattctgtagaatgtcagagttttcagtaaataagttccttggctttggaatgattttcaaatgtatttttaaacttgtatttgggtctccctttgacttcatgtgttctccctgttaatgcgtttgtatatagatttggtgacatttcccatgtacctattatgatctttctcccttgagttgttgtaaactgtatcagtatgaaatatgtgcatgccctagatgtgaaactcctcagcagctcgggttataatgtgtgtgtgtttcaccaagatgtcctttactgtgtcctcagattgcagtcacaaatgtagtcatttttactctctaactgttgagttgattaagagactttgcaaacgacaaagggatgaattccttactttaatctgttatcatttttcctatgtttccctctttgttcagaagcccagatgcatttttataactcagttttaaaaactttaaaatagttaccttgccttttaggatgttcttatcccacccataatgagagttgaaaggggatggatagctgctccccatgcccttcccactttttggaataggccgtgagggtgtgaggaagaaggctgtcttttgtacataaggacaaaattgtttgttttacataaattttgttacatatttttgctaatggctttgtatgtaacaagaagcgagttgccaaactacctgttgtacttttgaattttctgattgaattacagactgcgaacaacggctttcagaatgagggacttccatcagactctaatgataatagtagcacaaattgaaaacttccccaaagctttcacagaatattttctcataataaaatccaagtgaacagataattagaagaaacccttttccttcagggaaccaagcaactctattttagtactgacatgcattattttcactgtgaattcacttttttattgcatgttcagatgtccctctttgttttttttttttgtaacattaactgcaatgatgttcttcctggaattcatgaaaatataattaaaacacatttttaaaca

SEQ ID NO: 22477 - DNA, 3525 bp, Homo sapiens
ataatgccttgagggctttaacgcgctgcacgaagcatgcatgtctcatacccaaagtagccacagcgcctgcattcccacaatagcggcagccccgagcagatgcttccagcgtgcttatctggctgtgcttttcactttgggacaaagttctataatcatatctcatggatttattttctccacactataaagcctgaattgtgaagatctcatcatgccataaagggcagcatgagccaagttctgggggctgctaaggatttctttgccttttttccccccaccctttttggaaatgtgtatcaggaaaaggctttgcctttagagagaaattgtactgctcttgccaataatgtgtaatagtattaaatttaatggcagaccttgaagtgtataaaaacttaagtccagaaaaagttgaaagatgcatgagtgtgatgcagtccgggacacagatgatcaagctgaaacgtggaaccaaagggcttgtccgcctcttttacctggatgagcaccggacacgcctccgatggcgaccctctaggaagagtgagaaggcaaaaatacttattgattccatttacaaagtgactgagggccggcagtctgaaatattccacagacaagctgaggggaacttcgaccccagctgctgcttcaccatctaccatggcaaccacatggagtccctggacctcatcacctccaaccccgaggaggcccgcacctggatcacaggcctcaagtacctgatggctggcatcagtgatgaagactcccttgccaaaaggcagaggacccatgaccaatgggtgaagcagacctttgaggaagctgataagaatggtgacggcttgctgaatattgaagagatacatcagctgatgcataaactgaatgttaatctgccccgaagaaaagtcagacaaatgtttcaggaagccgacacagatgagaatcagggaactttgacatttgaagagttctgtgttttttacaaaatgatgtctttgagacgagacctttatttgttacttttgagctacagtgacaagaaagatcacctaactgtggaagaactggctcagtttttgaaggtggagcaaaagatgaataatgtgacaacggactattgtcttgacatcataaagaagtttgaagtttcagaagaaaataaggtgaaaaatgttcttggcatagaaggcttcacgaacttcatgcgtagtcctgcctgtgacatatttaacccattgcaccatgaagtgtaccaagacatggatcagcccctctgcaactactacattgcttcctctcacaatacatacctgactggagaccagctcctttctcagtccaaagtggatatgtatgcacgggtgctgcaagagggctgtcgctgtgtggaagttgactgttgggatggcccagatggagagccagtagtacatcatggttacactctcacttcaaaaattctcttcagagatgttgtggagaccatcaacaagcatgcctttgtgaagaatgagtttcctgttatattgtctatcgagaatcactgcagtatccagcagcaaaggaagattgctcagtacctgaaaggaatattcggagacaaactggacctgtcatctgttgatacaggggagtgcaagcagcttccaagccctcaaagtttgaaaggcaaaattctagtgaagggtaagaagttgccttatcaccttggggatgatgcagaggaaggggaagtttctgatgaggacagtgcagatgaaattgaagacgagtgcaaattcaagctccattatagtaatgggaccactgagcatcaggtggaatctttcataaggaaaaaactggagtcactgttaaaagaatctcaaattcgagataaagaagatcctgatagtttcacagtgcgggcactactgaaggccacgcatgaaggcttaaatgcacacctgaagcagagtccagatgtaaaggaaagtggaaagaaatcacatggacgatccctcatgaccaactttggaaaacataagaaaactacaaaatcacggtctaaatcttacagtactgatgatgaggaagacacacagcagagtactggcaaggagggtggccagctgtacagattgggtcgccgaaggaaaaccatgaagctctgccgagaactctctgatttggttgtgtacacaaactccgtggccgctcaggacattgtggatgacggaaccacaggaaatgtgttatcattcagtgaaacaagagcacatcaggttgttcagcaaaaatcagagcagttcatgatttataatcaaaagcaactcacgaggatttacccctctgcctaccgcattgattccagtaacttcaaccctctcccctactggaacgcaggctgccagctagtggcactgaattatcaatctgaaggacgaatgatgcagttaaaccgagccaaattcaaggcaaatggcaattgtggctatgtcctcaaaccccagcaaatgtgcaaaggtactttcaaccctttctctggtgaccctcttcctgccaaccccaaaaagcagctcatcctgaaagttatcagtggacagcaactccccaaacctccagactccatgtttggagatcgaggcgagatcattgacccttttgttgaagttgaaattattggattgccagtagattgttgtaaagatcaaacccgtgtggtagatgacaatggatttaaccctgtgtgggaagaaacactgacatttacagtacacatgccagaaatagctttggttcggttccttgtgtgggatcacgatcccattggacgagactttgttggacaaagaactgtgaccttcagcagcttagtgcctggctaccggcatgtctatttggaaggactgacagaagcatccatatttgtacacataaccatcaatgaaatctatggaaagaacagacaactccagggtctgaagggactgttcaataagaatcctaggcacagttcttcagaaaacaattcccattatgtacggaagcgatccattggagatagaattctgcgacgcacagctagcgccccagccaaaggcaggaaaaagagcaaaatgggcttccaagaaatggtggagataaaggattctgtgtccgaggccacaagagatcaagatggcgtgctgaggaggaccacacgcagtttgcaagcacgccctgtctctatgcctgttgacagaaaccttctgggagctttgtcgctgcctgtatctgaaacagcaaaagacattgaaggaaaagaaaactctctagactctagcttttgcaggccgactgagcaggctaaagcagaaatgtgcaaagtgcctttccccagacagttagaatgtgtaatgaagatggaaatttccgagacctgaatccccaaacccagactgatctctcttctcttcttgaatataaaagtaagctggcaagatttaaaaaactgaacccaaataaatattcatcatttttttcttc

SEQ ID NO: 22478 - DNA, 4031 bp, Homo sapiens
ggcgcgcacctgggtcactggcctgcgctacctcatggccggcatcagcgacgaggacagcctggctcgccgccagcgcaccagggaccaagtggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatgggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 22479 - DNA, 1909 bp, Homo sapiens
gcggctgcgtcagggattccttggtggccctggagggtggataggctggcctgggggccatcaggacagcaggtgacggtcaggccaatgccagccgggcctgggcacagccctgtgggggcttcggagggccctgaggaggaggaggaagaggcagaggagagaaggccccacggaggtcctgtcgccagcgctgccactgcctgacctccgctgcccgaaggccggtgggcctctgtggcctccgtgaagcaggcccggctgtcgtcaggccatgtctggtccatggccctcccccgacagccggaccaagggaacggtggcctggctggcggaggtactcctctgggttggagggagtgtggtgctgtcttcagagtggcagctcggccccctggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccggtaagcccctcttgccctgcgtggtcctcccgcacgcccctggcatggctgggcctgggtcacctgctgctgcttctgcgtggacggtgtcgcctcgtgtgctcgtgctcgtggctctgtatccgtggcactgtctccgtggcactctgctcccttggcttgcctgtggcccatag

SEQ ID NO: 22480 - DNA, 6453 bp, Homo sapiens
cacagggaacgggtagggtcccacggtttggggagagacatggcagtcctcaagggctgggatcagggcgcagccagggtttctgatggctttgctgatggtcaggacccaggcatgccaggcaaggcctcagcccagcagttgccaagcgtgtagccactttgggcccgtggagagagtcgcgctgcggagcccccagggggacctgaggtcacaagagcctcgatgcacctgagcgcggagctgggggtccctggagccgctgtccccacctgcggcgctggagccctggaggtgtccaggggcttccttggaacgtggagacgtgctggttaaacgtggagccccgggccagccgggcactgggggctgcaggtggagggaggtggatgctctccctcgtgggggcgtgtcttttccacaggaaagggaaagggggagggacacgggtcagcagtggggggctgtgcagtctcgcagatcttcacccttggttcttgaactctggaccctgagccctgccgagggtcccgcaaaggtgggcaaggagctcccggctgcttggtctccgcagtgttggggctgccagcagggggacgctgggcccccggggacctgacccgtgctccctccccaccccgcagtctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccagtggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccggtaagcccctcttgccctgcgtggtcctcccgcacgcccctggcatggctgggcctgggtcacctgctgctgcttctgcgtggacggtgtcgcctcgtgtgctcgtgctcgtggctctgtatccgtggcactgtctccgtggcactctgctcccttggcttgcctgtggcccatagccccagccctcctgtctgagcttgaggccctgggacttgggtggagctggtttgaggcccgacaggctgggaagaaccagctgctcttgctgagggtctggggccgggactgtggcctgacatgctgggcccctccggctgggcgcttccccaaactcacctcctgggcggctggcgacctgcatggcccctgatgcctttcctgggactgggggccacgtaccatcccattcccacctccctctagggcaggctccaggggtccctactgggaagtctgatgtgggcaggtagtgcagctgctgggcgtctcctgcgcccctgggacgcctggagcctgctgagtgctgcgtggagtagattccctgggccccagggcttcgctgctttgggctgaagcaccccactagaagggtgtctccttagcctggagggagggacatacacggagcccgccccacaccaccctgcccctccagacccccctgaccaagctttcctttctgcccccacccacgctgcctccgtagttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacagggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccctttc

SEQ ID NO: 22481 - DNA, 3949 bp, Homo sapiens
tggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccggtaagcccctcttgccctgcgtggtcctcccgcacgcccctggcatggctgggcctgggtcacctgctgctgcttctgcgtggacggtgtcgcctcgtgtgctcgtgctcgtggctctgtatccgtggcactgtctccgtggcactctgctcccttggcttgcctgtggcccatagccccagccctcctgtctgagcttgaggccctgggacttgggtggagctggtttgaggcccgacaggctgggaagaaccagctgctcttgctgagggtctggggccgggactgtggcctgacatgctgggcccctccggctgggcgcttccccaaactcacctcctgggcggctggcgacctgcatggcccctgatgcctttcctgggactgggggccacgtaccatcccattcccacctccctctagggcaggctccaggggtccctactgggaagtctgatgtgggcaggtagtgcagctgctgggcgtctcctgcgcccctgggacgcctggagcctgctgagtgctgcgtggagtagattccctgggccccagggcttcgctgctttgggctgaagcaccccactagaagggtgtctccttagcctggagggagggacatacacggagcccgccccacaccaccctgcccctccagacccccctgaccaagctttcctttctgcccccacccacgctgcctccgtagttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacagggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccctttc

SEQ ID NO: 22482 - DNA, 4837 bp, Homo sapiens
gcggctgcgtcagggattccttggtggccctggagggtggataggctggcctgggggccatcaggacagcaggtgacggtcaggccaatgccagccgggcctgggcacagccctgtgggggcttcggagggccctgaggaggaggaggaagaggcagaggagagaaggccccacggaggtcctgtcgccagcgctgccactgcctgacctccgctgcccgaaggccggtgggcctctgtggcctccgtgaagcaggcccggctgtcgtcaggccatgtctggtccatggccctcccccgacagccggaccaagggaacggtggcctggctggcggaggtactcctctgggttggagggagtgtggtgctgtcttcagagtggcagctcggccccctggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccagtggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 22483 - DNA, 4729 bp, Homo sapiens
gcggctgcgtcagggattccttggtggccctggagggtggataggctggcctgggggccatcaggacagcaggtgacggtcaggccaatgccagccgggcctgggcacagccctgtgggggcttcggagggccctgaggaggaggaggaagaggcagaggagagaaggccccacggaggtcctgtcgccagcgctgccactgcctgacctccgctgcccgaaggccggtgggcctctgtggcctccgtgaagcaggcccggctgtcgtcaggccatgtctggtccatggccctcccccgacagccggaccaagggaacggtggcctggctggcggaggtactcctctgggttggagggagtgtggtgctgtcttcagagtggcagctcggccccctggtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccaatggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatgggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtcc

SEQ ID NO: 22484 - DNA, 2449 bp, Homo sapiens
ttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccct

SEQ ID NO: 22485 - DNA, 5450 bp, Homo sapiens
cacgggcgggcgcggcagggcagcgtgtggggctgcgatcggcatgggctctgcgcgcggggtgcccctgctcgggctggggctcaggggacgccgggggccagcacagggcccggtgtccctcgggccgtgccggtaactgggattggcacccgccggccatggaagagcctgggcccccaggtgggctcagccaagaccaagtggagcggtgcatgggtgccatgcaagaggggatgcagatggtgaagctgcgtggcggctccaagggcctggtccgcttctactacctggacgagcaccgctcctgcatccgctggaggccctcacgcaagaacgagaaggccaagatctccatcgactccatccaggaggtgagtgaggggcggcagtcggaggtcttccagcgctaccctgacggcagcttcgaccccaactgctgcttcagcatctaccacggcagccaccgcgagtcgctggacctggtctccaccagcagcgaggtggcgcgcacctgggtcactggcctgcgctacctcatggccggcatcagcgacgaggacagcctggctcgccgccagcgcaccagggaccaatggctgaagcagacgtttgacgaggccgacaagaacggggatggcagcctgagcattggcgaggtcctgcagctgctgcacaagctcaacgtgaacctgccccggcagagggtgaagcagatgttcagggaagcggacacggatgaccaccaagggacgctgggttttgaagagttctgtgccttctacaagatgatgtccacccgccgggacctctacctgctcatgctgacctacagcaaccacaaggaccacctggatgccgccagcctgcagcgcttcctgcaggtggagcagaagatggcgggtgtgaccctcgagagctgccaggacatcatcgagcagtttgagccatgcccagaaaacaagagtaaggggctgctgggcattgatggcttcaccaactacaccaggagccctgctggtgacatcttcaaccctgagcaccaccatgtgcaccaggacatgacgcagccgctgagccactacttcatcacctcgtcccacaacacctacctcgtgggtgaccagctcatgtcccagtcacgggtggacatgtatgcttgggtcctgcaggctggctgccgctgcgtggaggtggactgctgggatgggcccgacggggagcccattgtgcaccatggctacactctgacttccaagatcctcttcaaagacgtcattgaaaccatcaacaaatatgccttcatcaagaatgagtacccagtgatcctgtccatcgaaaaccactgcagtgtcatccagcagaagaaaatggcccagtatctgactgacatccttggggacaagctggacctgtcatcagtgagcagtgaagatgccaccacactcccctctccacagatgctcaagggcaagatcctcgtgaaggggaagaagctcccagccaacatcagcgaggatgcggaggaaggcgaggtgtctgatgaggacagtgctgatgagattgacgatgactgcaagctcctcaatggggatgcatccaccaatcgaaagcgtgtagaaaacactgctaagaggaaactggattccctcatcaaagagtcgaagattcgggactgtgaggaccccaacaacttctccgtctccacactgtccccatctggaaagctcggacgcaagagcaaggctgaagaggacgtggagtctggggaggatgccggggccagcagacgcaatggccgcctcgtcgtgggaagcttctccaggcgcaagaagaagggcagcaagctgaagaaggcggccagcgtggaggagggagatgagggtcaggactccccgggaggccagagccgaggggcgacccggcagaagaagaccatgaagctgtcccgggccctctctgacctggtgaagtacaccaagtccgtggccacccacgacatagagatggaggcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatggttgccctgaactaccagtcagaggggcggatgctgcagctgaaccgagccaagttcagcgccaacggtggctgcggctacgtactcaagcctgggtgcatgtgccagggcgtgttcaaccccaactcggaggaccccctgcccgggcagctcaagaagcagctggtgctccggatcatcagtggccagcagcttcccaagccgcgcgactccatgctgggggaccgtggggagatcatcgacccctttgtggaggtggagatcattgggctccctgtggactgcagcagggagcagacccgcgtggtggacgacaacgggttcaaccccacctgggaggagaccctggttttcatggtgcacatgccggagatcgcgctggtccgcttcctcgtctgggaccacgatcccatcgggcgtgacttcattggccagaggacgctggccttcagcagcatgatgccaggctacagacacgtgtacctagaagggatggaagaggcctccatcttcgtgcatgtggctgtcagtgacatcagcggtaaggtcaagcaggctctgggcctaaaaggcctcttcctccgaggcccaaagcccggctcgctggacagtcatgctgctgggcggcccccggcccggccctccgttagccagcggatcctgcggcgcacggccagcgccccgaccaagagccagaagccgggccgcaggggcttcccggagctggtcctgggtacacgggacacaggctccaagggggtggcagacgatgtggtgccccccgggcccggacctgctccggaagccccagcccaggaggggcccggcagcggcagcccccgaggtaaggcgccagctgcggtggcagagaagagccctgtgcgagtgcggcccccgcgtgtcctggacggccccgggcctgctgggatggccgccacatgcatgaagtgtgtggtgggatcctgcgccggcgtgaacaccgggggcctgcagagggagcggccacccagcccggggcctgcaagcaggcaggcagccattcgccagcagccccgggcccgggctgactcactgggggccccctgctgtggcctggaccctcacgctatcccggggagaagcagagaggcccccaagggtcctggggcctggaggcagggtccaggcggtagcggctccatgtcctcggactccagcagcccagacagcccgggcatccccgaaaggtccccccgctggcctgagggtgcctgcaggcaaccgggggccctgcagggagagatgagtgccttgtttgctcaaaagctggaggagatcaggagtaaatcccccatgttctccgccgttaggaactgagagcggcgagtgacaggtaacggggcccagccccggtgtcccgtgctgtcccagcccaaggagggccccgtgtgcggcacagggcgtggactgggccccagcagcagcagggtggggacaccgagtgtgccgcgcccgggggatgcctcggggtgggagctgggcctggcgaccctcggcacagggcaccggggacaccaccctgatccgactcctctccgcctctctccctgcctccctctctctcttctgcttctccctctggctctctctcactcccccacctccccacagacacccgccccctctccacgcagcggccactccccccactgtgcagcctggaaaccatcgctgaggagcccgccccaggccctggtcccccgccaccagcggctgtccccaccagctcttctcagggacggcccccataccccacaggacccggagccaatgtggcaagccccctagaggacactgaggagccccgagacagcaggcctcggccgtgcaacggcgagggcgccggcggggcatacgagagggcccccggcagccagacggacggcaggagccagccccggaccctgggccacctgcccgtgattagaagggtgaagagtgaggggcaggtgcccacggagcccctgggagggtggcggcccctggccgctccctttccagctcctgccgtgtactccgatgccacgggcagtgacccgctgtggcagcggctggagccatgtggccaccgagacagcgtttcctcctcctccagcatgtcatccagcgacactgtcattgacctctccctgcccagcctgggcctgggccgcagccgtgagaacctcgctggagcccacatgggacgcctgccccccaggccccactcggcttcggctgcccgcccagacctgccacctgtgaccaagagcaaatccaaccccaaccttcgggctacaggccagcggcctcccatacctgacgaactgcagcccaggtccctggccccaaggatggctggcctccccttccggcctccctggggctgcctttccctggtgggcgtgcaggactgccccgtggctgccaagtccaagagcctgggcgacctcactgctgatgactttgcccctagctttgagggcggctcccgcagactgagccacagcctgggcctcccgggagggacacggcgggtgtcggggccaggggtgagacgggacaccctgacagagcagctgcgctggctcactgtcttccagcaggcaggagacatcacgtcacccaccagcctgggcccggctggggagggggtggcagggggccctggttttgtgcggcgctcctcctcccgcagccacagccgcgtgcgtgccattgccagccgggcccgccaggcccaggagcggcagcagagactgcagggcctgggccggcagggacccccagaagaggagcggggcacccccgagggcgcctgctccgtgggccacgagggcagtgtggatgcaccagcaccctccaagggagccctcgggccagcatccgcggctgctgaaaacctggtcctgctccgcctctgaccgtcagtggtgggaacctgggcggctctggaggcccagggcaggggtgggcgtgttgtttgctcaggaaacagggcagccaggcccccaaaactgtgtccccctggctgccctgtgtcccctccacccctgcctccctcctgcccctgctcccggggaggaaaggctaaagctgctggcccggggcccacaggaggggcttcgaggctggccctgccaggcagttttcccggcgttttaggatctgtacatagagaaatatttaaatttttagaagcaaaacttatacaacattaaaatgataccaagtccc

SEQ ID NO: 22486 - DNA, 2148 bp, Homo sapiens
acaatgggaattcagaccaaaaggaaaaaatgacagtcacctgacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaaggacaatgacaggctgaaacaaggaagaatcaccatagaagaatttagagcaatttatcgaattatcacgcacagagaagaaattattgagattttcaacacatattctgaaaaccggaaaattcttttagcaagtaatctggctcaatttctgacacaagaacaatatgcagctgagatgagtaaagctattgcttttgagatcattcagaaatacgagcctatcgaagaagttaggaaagcacaccaaatgtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 22487 - DNA, 1569 bp, Homo sapiens
acaatgggaattcagaccaaaaggaaaaaatgacagtcacctgacagtgtggtgcccagccaaccagctatacctcttttgaagattttaagaacttagcctcctgaacagtcttcttcgaaagtgaaaagtggtaacagctgatgagtatcaagaaattattttctgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaagacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 22488 - DNA, 2148 bp, Homo sapiens; identical to SEQ ID NO: 22486

SEQ ID NO: 22489 - DNA, 1398 bp, Homo sapiens
tgcaaaggggcagagttaattgtatttggaacccatgacagcacctactggggaaagacttctaagtgaggagaaacggctctacaggtcatgaaactatggaaatgagatggtttttgtcaaagattcaggatgacttcagaggtggaaaaattaacctagaaaaaactcagaggttacttgaaaaattagatattcggtgcagttatattcatgtgaaacagatttttaagacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatgcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagcca

SEQ ID NO: 22490 - DNA, 1667 bp, Homo sapiens
gtcattagaaggttttacaagatacatggattcacgtgaatgtctactgtttaaaaatgaatgtagaaaagtttatcaagatatgactcatccattaaatgattattttatttcatcttcacataacacatatttggtatctgatcaattattgggaccaagtgacctttggggatatgtaagtgcccttgtgaaaggatgccgttgtttggagattgactgctgggatggagcacaaaatgaacctgttgtatatcatggctacacactcacaagcaaacttctgtttaaaactgttatccaagctatacacaagtatgcattcatgacatctgactacccagtggtgctctctttagaaaatcactgctccactgcccaacaagaagtaatggcagacaatttgcaggctacttttggagagtccttgctttctgatatgcttgatgattttcctgatactctaccatcaccagaggcactaaaattcaaaatattagttaaaaataagaaaataggaaccttaaaggaaacccatgaaagaaaaggttctgataagcgtggagacaatcaagacaaggaaacaggggtaaaaaagttacctggagtaatgcttttcaagaaaaagaagaccaggaagctaaaaattgctctggccttatctgatcttgtcatttatacgaaagctgagaaattcaaaagctttcaacattcaagattatatcagcaatttaatgaaaataattctattggggagacacaagcccgaaaactttcaaaattgcgagtccatgagtttatttttcacaccaggaagttcattaccagaatatatcccaaagcaacaagagcagactcttctaattttaatccccaagaattttggaatataggttgtcaaatggtggctttaaatttccagacccctggtctgcccatggatctgcaaaatgggaaatttttggataatggtggttctggatatattttgaaaccacatttcttaagagagagtaaatcatactttaacccaagtaacataaaagagggtatgccaattacacttacaataaggctcatcagtggtatccagttgcctcttactcattcatcatctaacaaaggtgattcattagtaattatagaagtttttggtgttccaaatgatcaaatgaagcagcagactcgtgtaattaaaaaaaatggtcaaggtaatatggtcattattccagcatgagccaattagtttactatttctgtgggcatagactgcaccctagattgctatgtggtaaatgtgctcttgtgaccacaggtgaaccatagaaaacatagatatagtataattagaaattcatcagtgcttctggaaatcttttagtccaagatggaatgaaacattcacatttattattcatgtcccagaattggcattgatacgttttgttgttgaaggtcaaggtttaatagcaggaaatgaatttcttgggcaatatactttgccacttctatgcatgaacaaaggttatcgtcgtattcctctgttttccagaatgggtgagagccttgagcctgcttcactgtttgtttatgtttggtacgtcagataacagctaatgataaatgacatatcattagctatgcatcgcaataaaacagccaaaatg

SEQ ID NO: 22491 - DNA, 4160 bp, Homo sapiens
ccgcgcgcggcggcccgaggcggcggcggggacgcgggggcgcgaggacgcggctttgtgcaggcgggtctgctggggcgcccatggctgattgcgtgcgtgggtgggctgccgtcggcggggccctgcccacctccccgggcccgtccctcggtgccaagggcgccctgaaagccggagtgggggaagacggtgtcgggggaggtcgcctcgtccacgggcgggcgcgctatgacagcggcggggtttccaacggagactgcagcctcggcgtgtccggggacgaagcccgggctagccctaccaggggaccccgcggcgttgcgctcgccccgacccccagcgcggtcgtctgtaccctcccccgggagagcaagccgggcggcctgccccgccggagcagcatcatcaaggatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatgatatttctcc

SEQ ID NO: 22492 - DNA, 3348 bp, Homo sapiens
ccgcgcgcggcggcccgaggcggcggcggggacgcgggggcgcgaggacgcggctttgtgcaggcgggtctgctggggcgcccatggctggattgcgtgcgtgggtgggctgccgtcggcggggccctgcccacctccccgggcccgtccctcggtgccaagggcgccctgaaagccggagtgggggaagacggtgtcgggggaggtcgcctcgtccacgggcgggcgcgctatgacagcggcggggtttccaacggagactgcagcctcggcgtgtccggggacgaagcccgggctagccctaccaggggaccccgcggcgttgcgctcgccccgacccccagcgcggtcgtctgtaccctcccccgggagagcaagccgggcggcctgccccgccggagcagcatcatcaaggatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagataagaaagacaggaaggaggagtatttttgtgcctcagactcccataatggtatga

SEQ ID NO: 22493 - DNA, 4153 bp, Homo sapiens
ccgcgcgcggcggcccgaggcggcggcggggacgcgggggcgcgaggacgcggctttgtgcaggcgggtctgctggggcgcccatggctggattgcgtgcgtgggtgggctgccgtcggcggggccctgcccacctccccgggcccgtccctcggtgccaagggcgccctgaaagccggagtgggggaagacggtgtcgggggaggtcgcctcgtccacgggcgggcgcgctatgacagcggcggggtttccaacggagactgcagcctcggcgtgtccggggacgaagcccgggctagccctaccaggggaccccgcggcgttgcgctcgccccgacccccagcgcggtcgtctgtaccctcccccgggagagcaagccgggcggcctgccccgccggagcagcatcatcaaggatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatgat

SEQ ID NO: 22494 - DNA, 3940 bp, Homo sapiens
gaaacgtacctaagtattattggacagccggagtattttacagtggttgctgctcaggaaatttgagtgaaggactgcaaaagaggagcaaagcagacccgagagagaaggcagcagtgctcccctgtgacgtgctccatcaccgggcagggaagacaccgctgccacctctccacagccttgttcaagagcactggaaattgatggtacaaaacagaagagggaacggaaaaagacagtctcattcagcagcatgccaacagagaagaagatcagcagtgcaagtgattgtattaattcaatggttgagggttcagaactcaaaaaggttcgctccaactctagaatttatcataggtactttttactggatgctgacatgcagagcctaaggtgggagccatctaagaaggattctgagaaagccaagattgacattaaatccatcaaggaagtgagaacaggaaaaaacacagacatattccgcagcaatggcatttctgaccagatatctgaagattgtgcgttttccgtcatatatggagagaattatgagtcactggatttggttgccaactccgcagatgttgcaaacatctgggttacaggactgcggtacctaatttcttatggaaaacatacacttgatatgttagaaagtagccaagataacatgaggacttcttgggtttcacaaatgtttagtgaaattgatgtagataaccttggacatataactctgtgtaatgctgtgcaatgtatcagaaacctcaatcctggtttaaaaacgagcaaaattgagcttaagttcaaagaattgcataaatcaaaggacaaagctggtaccgaggtcacaaaggaagaatttattgaggtttttcatgagctttgtactagacctgaaatttatttccttttagttcagttttcaagcaataaagaattccttgataccaaggaccttatgatgtttcttgaggcagaacagggtgtggcacatataaatgaggaaataagccttgaaattattcacaaatatgaaccatccaaagagggtcaggaaaagggctggctctccatagacgggttcactaattaccttatgtcacctgactgttatatattcgatccagaacataagaaggtctgtcaggatatgaagcaacctctgtctcattactttataaactcatctcataatacatacttaatagaggatcagttccgaggtccctccgacatcacaggatatattcgagctcttaaaatgggttgccggagtgttgaattagatgtatgggatgggccggacaatgaacctgtaatttacacaggccacaccatgacctctcagatagttttccgcagtgtcattgatattattaacaagtatgcattctttgcttcagagtatcctcttatcttgtgtttagaaaaccactgttccattaaacaacagaaggtaatggttcagcacatgaagaaacttttaggagacaagctctatacaacatcacccaatgttgaggaatcttatctaccatccccagatgtcctgaaagggaaaatactaattaaagcaaagaagctgtcctcaaattgctctggggtagaaggagatgttactgacgaagatgaaggagcagaaatgtctcagaggatgggaaaagagaacatggagcaacccaataatgtgcctgtgaagcgatttcagctttgtaaagaactgtctgaactggtcagcatctgcaaatcagttcagttcaaagaatttcaggtgtcgtttcaggttcagaagtactgggaagtctgttcctttaatgaagtgcttgccagcaagtacgccaatgaaaatccaggggactttgtaaattacaacaaacgttttcttgctagggtttttcccagtccaatgagaattgattccagtaacatgaatcctcaagatttttggaaatgtggttgccaaattgtagccatgaactttcagacaccaggactgatgatggacctgaatattggctggtttaggcagaacggaaactgtggctatgtcctccggccagccatcatgagggaggaggtctccttcttcagcgccaatacaaaagactctgtcccaggggtctcacctcaacttcttcacattaaaatcatcagtgggcagaactttcccaagcccaaaggatcaggtgccaaaggtgatgtggtagatccttatgtctatgttgaaatccatggaatccctgctgattgtgcagaacaaaggacaaaaacagtgcaccagaatggagacgctcccatttttgatgaaagctttgaatttcaaatcaacctgcctgaactggccatggtgcgctttgtagtgctggatgatgactacattggggatgaattcatcggccagtacacaattccctttgaatgtttacagacgggctaccgccatgtccccctgcagtccttaactggagaggtccttgcacatgcttctttatttgtccacgtggctattactaaccgaagaggaggaggaaagcctcataaaaggggcctttctgtgagaaaagggaagaaatccagggaatatgcatctttgagaacactgtggattaaaaccgtggatgaggtattcaagaatgcccagccccctatacgggatgccacagatctgagagaaaacatgcagaatgcggtggtgtcattcaaggagctgtgtggcctctcctctgtggccaatctcatgcagtgcatgttggcggtgtctccccgctttctggggcccgataacacacccctagtggtcctaaatctcagcgagcagtaccccacaatggagctgcagggaattgtgccggaggttctgaagaagatcgtaacaacttatgacatgatgattcagtccctcaaggcgttgattgaaaatgcagatgctgtatatgaaaagatcgtacattgtcagaaggcagccatggaattccatgaacacttgcacagcataggcaccaaggaaggtttgaaggaaagaaaactacaaaaagcagtggagagctttacctggaatattaccatcttaaagggacaagcagatcttttgaaatatgctaagaatgagacattggagaacctgaaacaaatccattttgctgctgtttcatgtggactgaataaaccaggcaccgaaaatgctgatgtccagaagccacgccggagcttggaagtcatacccgaaaaagcaaacgatgaaactggagaatgaggaaacttacaataaaccattatggagtttataactctaggaccaattgtagtcagatgggacatttgctttgcactcactaatgagaataatattcgggattttaaagcacaactggaatagctaattacagtctattaaaactgtgaatgtatgtagcaatcctgcgtgtgaaggcaaataaactctttaacaggcaattatattgctggccaaaatatgctatatttgtatacaaagacattctaactcagttccagtatgaagaaagattattcactctagctccactgagaaacattttcctaagtgaaaacaatttcttaagatggaaatggattggattgtcaaattattatttattggagaaaaaaacctgatctacacatttttacttatatggggttgccagagtctctgggttctagatgattttggtggcatgcttgctgagccataattactaaagagaatgtaagtggacgggttccctgaatccccggggtccttggagagccatcgaggagaatgtgcaattggactgaagctccctggctgaagatacatgccgagtcagcacatgggtagagatgatgtaaaagcagccaatctggaaacaatacattgtaaatagtttttcattgtatgaagtagtgttcacattaaaaagatgttttatga

SEQ ID NO: 22495 - DNA, 3501 bp, Homo sapiens
cgagggcaggccctgagccccggccccgcctcggccggccccgcctcggccggggcgtgggctccggctgcagctccggtctgctctcttggctccggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggagggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcaggtttgccttgagtctgcggaagcactgcttcggtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaaggtt

SEQ ID NO: 22496 - DNA, 3391 bp, Homo sapiens
ctccggtctgctctcttggctccggaacccccgcgggcgctggctccgtctgccagggatgacggcgacccctgagagcctcttccccactggggacgaactggactccagccagctccagatggagtccgatgaggtggacaccctgaaggagggagaggacccagccgaccggatgcacccgtttctggccatctatgagcttcagtctctgaaagtgcaccccttggtgttcgcacctggggtccctgtcacagcccaggtggtgggcaccgaaagatataccagcggatccaaggtgggaacctgcactctgtattctgtccgcttgactcacggcgacttttcctggacaaccaagaagaaataccgtcattttcaggagctgcatcgggacctcctgagacacaaagtcttgatgagtctgctccctctggctcgatttgccgttgcctattctccagcccgagatgcaggcaacagagagatgccctctctaccccgggcaggtcctgagggctccaccagacatgcagccagcaaacagaaatacctggagaattacctcaaccgtctcttgaccatgtctttctatcgcaactaccatgccatgacagagttcctggaagtcagtcagctgtcctttatcccggacttgggccgcaaaggactggaggggatgatccggaagcgctcaggtggccaccgtgttcctggcctcacctgctgtggccgagaccaagtttgttatcgctggtccaagaggtggctggtggtgaaggactccttcctgctgtacatgtgcctcgagacaggtgccatctcatttgttcagctctttgaccctggctttgaggtgcaagtggggaaaaggagcacggaggcacggcacggcgtgcggatcgatacctcccacaggtccttgattctcaagtgcagcagctaccggcaggcacggtggtgggcccaagagatcactgagctggcacagggcccaggcagagacttcctacagctgcaccggcatgacagctacgccccaccccggcctgggaccttggcccggtggtttgtgaatggggcaggttactttgctgctgtggcagatgccatccttcgagctcaagaggagattttcatcacagactggtggttgagtcctgaggtttacctgaagcgtccggcccattcagatgactggagactggacattatgctcaagaggaaggcggaggagggtgtccgtgtgtctattctgctgtttaaagaagtggaattggccttgggcatcaacagtggctatagcaagagggcgctgatgctgctgcaccccaacataaaggtgatgcgtcacccagaccaagtgacgttgtgggcccatcatgagaagctcctggtggtggaccaagtggtagcattcctggggggactggaccttgcctatggccgctgggatgacctgcactaccgactgactgaccttggagactcctctgaatcagctgcctcccagcctcccaccccgcgcccagactcaccagccaccccagacctctctcacaaccaattcttctggctgggcaaggactacagcaatcttatcaccaaggactgggtgcagctggaccggcctttcgaagatttcattgacagggagacgacccctcggatgccatggcgggacgttggggtggtcgtccatggcctaccggcccgggaccttgcccggcacttcatccagcgctggaacttcaccaagaccaccaaggccaagtacaagactcccacatacccctacctgcttcccaagtctaccagcacggccaatcagctccccttcacacttccaggagggcagtgcaccaccgtacaggtcttgcgatcagtggaccgctggtcagcagggactctggagaactccatcctcaatgcctacctgcacaccatcagggagagccagcacttcctctacattgagaatcagttcttcattagctgctcagatgggcggacggttctgaacaaggtgggcgatgagattgtggacagaatcctgaaggcccacaaacaggggtggtgttaccgagtctacgtgcttttgcccttactccctggcttcgagggtgacatctccacgggcggtggcaactccatccaggccattctgcactttacttacaggaccctgtgtcgtggggagtattcaatcctgcatcgccttaaagcagccatggggacagcatggcgggactatatttccatctgcgggcttcgtacacacggagagctgggcgggcaccccgtctcggagctcatctacatccacagcaaggtgctcatcgcagatgaccggacagtcatcattggttctgcaaacatcaatgaccggagcttgctggggaagcgggacagtgagctggccgtgctgatcgaggacacagagacggaaccatccctcatgaatggggcagagtatcaggcgggcagtgtgattcttggagcaaatacccggccagacttggatctccgagaccccatctgtgatgacttcttccagttgtggcaagacatggctgagagcaacgccaatatctatgagcagatcttccgctgcctgccatccaatgccacgcgttccctgcggactctccgggagtacgtggccgtggagcccttggccacggtcagtccccccttggctcggtctgagctcacccaggtccagggccacctggtccacttccccctcaagttcctagaggatgagtctttgctgcccccgctgggtagcaaggagggcatgatccccctagaagtgtggacatagttgaggcccccgtcagggagaggtcaccagctgctgtgccccaccacgtctggctccctgccccttaaccccaaggactgagggcagtgccctttgagatctggggaggcaggcattcctgaagggaactagaggtgttacagaggacccttacgtgagaaatagctgaaaagggcactcccaaccctgggctggggaggaggagagagtcccagagctcatcccccctgctgcccagtgcaaaccacttctccatgctgcaaaggagaagcacagctcctgccagggtgagcagggtcaagcctcttattccaggagaagggggctctgccccaggccctactacccattgttcccttcctcttcctgcccttgaaccccctccctgtcccagggccctcccagcccattgctgccaaggtggagggaaggataaagccacttctggcttcagcccccaccaggggaaggaaggagggcacattaactccctccaccagcctgctgacagacactaactttgtatccgttcaataagcatttcataaataaaggtgtagaaaa

SEQ ID NO: 22497 - DNA, 2233 bp, Homo sapiens
gagtcccagttcctctccttaaccaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgta

SEQ ID NO: 22498 - DNA, 1384 bp, Homo sapiens
gccccggctctctggaccttgtctcgctcgggagcggaaacagcggcagccagagcataaaatacacaagaggatttttatggaatggctccttgttacaaggaccacataaacccattttgaattattcaaccattgctgaacttcttgaaactgttttaatcatggacaaacaaaactcacagatgaatgcttctcacccggaaacaaacttgccagttgggtatcctcctcagtatccaccgacagcattccaagatagatcagatactgattcatcagcaaattgaacttctggaagattaaatctcttgatgaacagtgtgtggttggcaaaatttccaagcactggactggaattttgagagaggcatttacagacgctgataactttggaatccagttccctttagaccttgatgttaaaatgaaagctgtaatgattggtgcctgtttcctcattgacttcatgttttttgaaagcactggcagccaggaacaaaaatcaggagtgtggtagtggattagtgaaagtctcctcaggaaatctgaagtctgtatattgattgagactatctaaactcatacctgtatgaattaagctgtaaggcctgtagctctggttgtatacttttgcttttcaaattatagtttatcttctgtataactgatttataaaggtttttgtacattttttaatactcattgtcaatttgagaaaaaggacatatgagtttttgcatttattaatgaaacttcctttgaaaaactgctttgaattatgatctctgattcattgtccattttactaccaaatattaactaaggccttattaatttttatataaattatatcttgtcctattaaatctagttacaatttatttcatgcataagagctaatgttattttgcaaatgccatatattcaaaaaagctcaaagataattttctttactattatgttcaaataatattcaatatgcatattatctttaaaaagttaaatgtttttttaatcttcaagaaatcatgctacacttaacttctcctagaagctaatctataccataatattttcatattcacaagatattaaattaccaattttcaaattattgttagtaaagaacaaaatgattctctcccaaagaaagacacattttaaatactccttcactctaaaactctggtattataacttttgaaagttaatatttctacatgaaatgtttagctcttacactctatccttcctagaaaatggtaattgagattactcagatattaattaaatacaatatcatatatatattcacagagtataaacctaaataatgatctattagattcaaatatttgaaataaaaacttgatttttttgt

SEQ ID NO: 22499 - DNA, 1198 bp, Homo sapiens
gttcctctccttaaccaccggacaaacgtctctggagtctctccaatgagcaagaaagcaagtcgggggtaggggaggggcctcacaccagggggtgggcgcagtccctcctccagctccttcaccctccagtagtctcgtgggtccccgagcgccagcgcgggaaccgggaaaaggaaaccgtgttgtgtacgtaagattcaggaaacgaaaccaggagccgcgggtgttggcgcaaaggttactcccagacccttttccggctgacttctgagaaggttgcgcagcagctgtgcccggcagtctagaggcgcagaagaggaagccatcgcctggccccggctctctggaccttgtctcgctcgggagcggaaacagcggcagccagagcataaaatacacaagaggatttttatggaatggctccttgttacaagaactgttttaatcatggacaaacaaaactcacagatgaatgcttctcacccggaaacaaacttgccagttgggtatcctcctcagtatccaccgacagcattccaaggacctccaggatatagtggctaccctgggccccaggtcagctacccacccccaccagccggccattcaggtcctggcccagctggctttcctgtcccaaatcagccagtgtataatcagccagtatataatcagccagttggagctgcaggggtaccatggatgccagcgccacagcctccattaaactgtccacctggattagaatatttaagtcagatagatcagatactgattcatcagcaaattgaacttctggaagttttaacaggttttgaaactaataacaaatatgaaattaagaacagctttggacagagggtttactttgcagcggaagatactgattgctgtacccgaaattgctgtgggccatctagaccttttaccttgaggattattgataatatgggtcaagaagtcataactctggagagaccactaagatgtagcagctgttgttgtccctgctgccttcaggagatagaaatccaagctcctcctggtgtaccaataggttatgttattcagacttggcacccatgtctaccaaagtttacaattcaaaatgagaaaagagaggatgtactaaaaataagtggtccatgtgttgtgtgcagctgttgtggagatgttgattttgagattaaatctc

SEQ ID NO: 22500 - DNA, 1265 bp, Homo sapiens
ggccgaatggagaatgaagccttttcaaattcacctcccagtgaaccaccctcaaaatagaagtgaatgtgaaaccacagatatttcattaaaacatatctgaagataaaaacatacctcaagcttcacagatataggacttctgagctgagaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgagattacatctcttgatgaacaaattgtggttggcaggatttctaagcactggtctgggtttttaagagaggcatttactgatgctgacaactttggaatccaattccctagagaccttgatgttaaaatgaaagccgtgatgattggtgcctgtttcctcattgactacatgttttttgaaagaactaggtaatgactggaatgtcagagtgtgggagtggattaatgattccggatctttggctaggcaaaatgaaactataactgatctaaacggttccttccttcttctactgtgcaaggaagatgtaaggaaaaactcgcacactatctgtggaactcatttaaattcaaatactagataaacatttcgcattgaatatttacatggagaaaaatcatcaaacatcaacaattatcaagttaattaataaaaatactaggtattgc

SEQ ID NO: 22501 - DNA, 759 bp, Homo sapiens
gtatctgcccatcttagattcttcctagcaataattctgagagactctggattgtgggccgaatggagaatgaagccttttcaaattcacctcccaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgag

SEQ ID NO: 22502 - DNA, 1441 bp, Homo sapiens
acaccagaaccgttcgaatgacaaggggtgtcctgcctgaaaacgccttgcggggctcagcttccccttagctacactgctttacaggtagagagcggccctgaatcctgggcagagtctgggctcaggagcatgtgccagcatagtggggctattagaagggacggttaatacagcctgcaagctgtcatttatcaggccaaataaacccacttggaattattcaacctttgctgaacttcttgagtagatgtaactaagaggtgactataattggagaattcttaagagtttcactatattatgaaaatgtgtgcttaaagttggtaatcataaaaaataattttgaaatggcagcttatgaaaggatattatttgtagctgtgttttcccttgtaaattccagtactgggcactcctgaaaacttcgcaagatatatatgagatcatggaactcactcttctgcttaaattcctccagacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgagattacatctcttgatgaacaaattgtggttggcaggatttctaagcactggtctgggtttttaagagaggcatttactgatgctgacaactttggaatccaattccctagagaccttgatgttaaaatgaaagccgtgatgattggtgcctgtttcctcattgactacatgttttttgaaagaactaggtaatgactggaatgtcagagtgtgggagtggattaatgattccggatctttggctaggcaaaatgaaactataactgatctaaacggttccttccttcttctactgtgca

SEQ ID NO: 22503 - DNA, 1208 bp, Homo sapiens
gtatctgcccatcttagattcttcctagcaataattctgagagactctggattgtgggccgaatggagaatgaagccttttcaaattcacctcccaggacctcccggacatattgtctaccctaagcaccaggctggacacactgggaaacaggctgaccacctgggctcccaggccttctacccaggacgtcagcatgactacctagtcccacctgctggcacagctggcattcctgttcaaaatcagccaggtagacctgaaggggtaccatggatgccagcaccaccaccaccattaaactgtccgccaggattggaatacttaagtcagatagatatgatactaattcatcagcaaattgaacttctggaagttctattcagttttgaaagtagtaacatgtatgaaatcaagaacagctttgggcagaggatttattttgcagcagaagatactaatttctgtatccgaaattgctgtgggcggtctagaccttttaccttgaggattactgataatgtgggtcgagaagtcataactctggaaagaccactaagatgtaactgttgttgttgcccctgctgccttcaggagatagaaatccaagctcctcctggtgtaccagtaggttatgttactcagacctggcacccatgtctaacaaagtttacaattaaaaatcagaaaagagaggatgtactaaaaattagtggtccatgtatcgtgtgcagctgtattgcgggtgttgattttgagattacatctcttgatgaacaaattgtggttggcaggatttctaagcactggtctgggtttttaagagaggcatttactgatgctgacaactttggaatccaattccctagagaccttgatgttaaaatgaaagccgtgatgattggtgcctgtttcctcattgactacatgttttttgaaagaactaggtaatgactggaatgtcagagtgtgggagtggattaatgattccggatctttggctaggcaaaatgaaactataactgatctaaacggttccttccttcttctactgtgcaaggaagatgtaaggaaaaactcgcacactatctgtggaactcatttaaattcaaatactagataaacatttcgcattgaatatttacatggagaaaaatcatcaaacatcaacaattatcaagttaattaataaaaatactaggtattgc

SEQ ID NO: 22504 - DNA, 1746 bp, Homo sapiens
ctgtgagctgccgagtgctaggcacccgggctcttctgggggctccagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttgg

SEQ ID NO: 22505 - DNA, 1734 bp, Homo sapiens
cgagtgctaggcacccgggctcttctgggggctccagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttgg

SEQ ID NO: 22506 - DNA, 2557 bp, Homo sapiens
ctgttctacagctatggccgggccagctgcagctttccgccgcttgggcgccttgtccggagctgcggccttaggcttcgcttcctacggggcgcacggcgcccaattcccagatgcctacgggaaggagctgtttgacaaggccaacaaacaccacttcttacacagcctggccctgttaggggtgccccattgcagaaagccactctgggcggcctgagcacgctcactgacaccgtttggcggcctgtcacccgcgtggctggggcacctgcagaaactgctgtcgctgcgaggtgcccgtgtgggtcaccgctgtgccagggagagaagacggcgaggtcgcccctgggaggcagaaggcgagccaggagccagtcctggaagccaatgagcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccaggtgagcgggggcacagaggggtcagggagaccgcccttggggtggggctgtcggtctgaccgcgggtccatctgtcctgccgtcggcccacagcctcctccgcaggatgggagaacaaagggagggggcggttctggggcccccgagggaatccagggtcccaggtacccggtcccgcccactgacacttgggtttctccccgagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggac

SEQ ID NO: 22507 - DNA, 2032 bp, Homo sapiens
cagggcgctgagcacgcacgccgccggcctggcggcgttcgcggggcccgggaccagccgccgccttctccaggcgctcctactctctgggcatctgcagtccgagcggaaggggcgggaacgtcggcgacgccgaggagcaaagcccacgatcggcttcccggggcagcggacggctgccttcctcccggcgcaaacgcaccgcccaggagggggcgggctcggcgggtcggggggcggggccggggtccgagctcgggcccgcctccgcctccgccagctcctgtgagctgccgagtgctaggcacccgggctcttctgggggctccagtcagaggcgccgcccaagagaccctgggccggcgccgggcgcagctgcctctccgtctttgtgtctgtctctgtgtctgtctggctatctccgagtttgcctccgcttccagaactaagccacccagacaccatcatctcgaaaaccccagcccttctcccatggcaggctacttgccccccaaaggctacgccccttcgcccccacctccctaccctgtcacccctgggtacccggagccggcgctacatcctgggcccgggcaggcgccagtgcccgcccaggtacctgccccagctcccggcttcgccctcttcccctcgcctggccccgtggccttggggtctgctgcccccttcttgccactgccaggggtgccttctggcctcgaattcctggtgcagattgatcagattttgattcaccagaaggctgagcgagtggaaacgttcctaggctgggagacctgtaatcggtatgaactgcgctctggggccgggcagcccctgggtcaggcggccgaggagagcaactgctgcgcccgtctgtgctgtggcgcccgccggccgctgcgtgtccgcctggccgaccccggggaccgtgaggtgctgcgtttgctccgcccgctgcactgtggctgcagctgctgcccctgtggcctccaggagatggaagtacaggctccaccaggcaccaccattggccacgtgctacagacctggcatcccttcctccccaagttctccatccaggatgccgatcgccagacagtcttgcgagtggtggggccctgctggacctgtggctgtggcacagacaccaactttgaggtgaagactcgggatgaatcccgcagtgtgggccgcatcagcaagcagtgggggggcctggtccgagaagccctcacagatgcagatgactttggcctacagttcccgctggacctggatgtgagggtgaaggctgtgctgctgggagccacattcctcattgactacatgttctttgagaagcgaggaggcgctgggccctctgccgtcaccagttagaggccaccatggtgtgaggagaccatcacctcgaccagaactccagatggtcacctgccctggcccctcctctgggcagcccctttcctccatgtacactgcaggggacagaaggggggccccatccctaccctactccctggccgcctgcccctgtggttcccaaggaggggtatgtatgagagccgctctcctgctacctcccaccactgtcccagcagtccctcggcacacaggcatatcagctttcacactttccccatgcactctctcccacccccttccagggcctctgctccaaaggaggcctctggaacccaggactctggggttttacaagagggctggggtgtggaagggcaagctgcaccaaagacggtggatatagccaccgcccccccgccgctgcctagcatctgcttggccaattagttcagcctcagaccatggcactttgagggggtctctacctccccatcaacagctgcagggggaccccagtgccaacttcctctcccactagggccctgccttcagctggtgcttgctgcgattcctgtgccttatgtaactgcccttccttcccttgccctaggaaaaaggctgcatctttatatgttacattcatataaactttgtaactttttggaca

SEQ ID NO: 22508 - DNA, 3303 bp, Homo sapiens
cgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagt

SEQ ID NO: 22509 - DNA, 3033 bp, Homo sapiens
cgagacggggaagccgcgcgcggggaaggagggtccaggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctggaatttgtgcgttcatgctttttcgtattctttatggcttttaaataaatatacaatggttaatagt

SEQ ID NO: 22510 - DNA, 1442 bp, Homo sapiens
ggccgcggtgcctgcgggcaggcgcggaggttgcgcggcgtcctgcgctagcagttcccggacactgcgctcgcgtcgcatcctcaggtggttgcagaagttccgtggtgtcgggcgcgcgtctgcactgcagacgcagagggtttgggagcgagcagtttcctgcccagggatgggggtcctggctgcacttcacgggggcggccctttcgtttcgctctgcgtgacaggtctcgcttgattgggtttctcatgggtctctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttatt

SEQ ID NO: 22511 - DNA, 1054 bp, Homo sapiens
cccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggtctcgcttgattgggtttctcatgggtctctggcgtttctacggcgcggctctcacggactcaggccaggccactcgcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgag

SEQ ID NO: 22512 - DNA, 814 bp, Homo sapiens
gtttataacttgaaaaatcctctccgtctcccttccctgcctcctttcctttccctttcctctgccagtacaactagacccggcgtctggcgtccccggtgcccagcattctgcggggcaggcgcttggagacacatagggcaccgtacaacaaactccagctccagaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagag

SEQ ID NO: 22513 - DNA, 683 bp, Homo sapiens
gtgtttctcttaagcttgttacattgttttcctcataactgtactatctaacgttaaactttaacatttcttgactttttttaaatctcattctactacaatataaactgcagcacagtaggtggcagagtgtctgtctgcttcattgctgtactctcaacatctgtattagtgcctcgtacataataggtgctcaataagtatttttttaattaatgaagggacaaatgtaaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagata

SEQ ID NO: 22514 - DNA, 1375 bp, Homo sapiens
aggcgtgccggacccgcccccagaacccgcgcctagccctcccttccgcgcgcttactttgtttataacttgaaaaatcctctccgtctcccttccctgcctcctttcctttccctttcctctgccagtacaactagacccggcgtctggcgtccccggtgcccagcattctgcggggcaggcggtctcgcttgattgggtttctcatgggtctctggcgtttctacggcgcggctctcacggactcaggccaggccactcgcagcttggagacacatagggcaccgtacaacaaactccagctccagaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagttggacaacatacatgttcttcagcattttgagcctctggaaatgatgacatgttttgaaactaataatagatatgatattaaaaacaactcagaccagatggtttacattgtaaccgaagacacagatgactttaccaggaatgcctatcggacactaaggcccttcgtcctccgggtcactgattgtatgggccgagaaatcatgacaatgcagagacccttcagatgcacctgctgttgcttctgttgcccctctgccagacaagagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttgga

SEQ ID NO: 22515 - DNA, 593 bp, Homo sapiens
aacatttcttgactttttttaaatctcattctactacaatataaactgcagcacagtaggtggcagagtgtctgtctgcttcattgctgtactctcaacatctgtattagtgcctcgtacataataggtgctcaataagtatttttttaattaatgaagggacaaatgtaaggtaactggaggttaaaaaaattacagaaatccttacctgtgttactgagtagcaatactatttattatgtatgtattttaaaggcattaacattttttatttttcaggattaattggaattcttcaaaatgtcaggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataac

SEQ ID NO: 22516 - DNA, 2839 bp, Homo sapiens
ataacttgaaaaatcctctccgtctcccttccctgcctcctttcctttccctttcctctgccagtacaactagacccggcgtctggcgtccccggtgcccagcattctgcggggcaggcggtgtggtacccacagcccctgaacagcctgcaggtgaaatggaaaatcaaacaaaaccaccagatccaaggcctgatgctcctcctgaatacaattctcattttttaccaggaccccctggaacagctgtccctccacctactggctacccaggaggcttgcctatgggatactacagtccacagcaacccagtaccttccctttgtaccagccagttggtggtatccatcctgtccggtatcagcctggcaaatatcctatgccaaatcagtctgttccaataacatggatgccagggccaactcctatggcaaactgccctcctggtctggaatacttagttcagctggaggtgcagtgtcctcctggtgtcaccattggctttgttgcggaacattggaacctgtgcagggcggtgtacagcatccaaaatgagaagaaagaaaatgtgatgagagttcgtgggccatgctcaacctatggctgtggttcagattctgtttttgaggtcaaatcccttgatggcatatccaacatcggcagtattatccggaagtggaatggtttgttatcagcaatggcagatgctgaccattttgacattcacttcccactagacctggatgtgaagatgaaagccatgatttttggagcttgcttcctcattgacttcatgtattttgaaagatctccaccacaacgttcaagatagagagacacagcaagccatcaactatggttaattttgaaaaatggaaaagttggattgggcttacagtcagcactcagttatttgcaagtgtatttctttgctttgtagagtatttttattgggtgttaactttgacagctgagagtgggcttgcaagaacacaatctaaaagtgtgtttcaattgagtatctctctagtagaataggagttcatcctgaaaagctgtgactcattaacccagtaaacatatacaaagtaagcttaaaacactataaacatgagataagggaaaatgaatccagagttctcatattaataggtagtgaaacaataaggctttttagagcagactttgttggcataaaataacctggcttctatccctaaccctttcctacctttcctctccgtcaacatgtcctcatactgaagacaaacttgtttcaatgatagtcttcatttttaaaaacaaaaaggcaggcagacagaaataatgatgttttcttgcactaagaaggtactacttgtacacatatatcaaaacctcattctgcaaagtttttgaaggtttcaatgggaaatttgattttattacaaaataaaacattttttaatgttaaagtttatatattccatgcttgttttctcattcactggcatggatgatcaggagctgcctatatatgaaggcagaatcagactatcaggaaaggagctggccagggccacagccagtcaagatctctgagcaacttagagacattggtgtcattatatgaagcttgcatttaatacatttatacataatacatttgtacatttaattcataacgtctcttggtcacagatgccttatatataaaataagttgccagatctctaagattgcctagtacacctttgtatctcatttgatgtgatacccagaagagatcattgttttttgtttttgtttttgtttttttcaagaagatccttcgtgatcaccatgctgttctcatggtaagaactggagttatgtttttaaatttggaaatatgacattttatgtagcactttataaaaagtgaaagcgacaaattccaccgctgcttaatactgctttgcttctttttattgacatgatagataaatatgtatctacacagagtaataataataaaacacagtaaacattctatttctctatggtctacagcatgccagtaaataatatgtaggaccaataataaattatcaattacacatttttgtgttaactaattaaaagcatagtgtataagtgagtacactctaattaacttgcttctgttgcactttagttttctacctgcatatggactgcattttttttttttaacacagtcagtatgtagaatgggatgtattcttctgctgctgcttattaaataaagaaagcctgagtgttcttagatggggttattctgagatgagggtcttagcctacagttctttttgaaatgaaaggtgctttgttttttaattatattcatcttttcagggtaaatttgtttttctgagtttctcgtaatgctcatttttacatgctgctactagcttttttttttaaaaaaagtaaaagttgctgctttctaaaatattaattgccttatatttgaaagtgccattgcaatcgtaagtagactatgtatttcctataatgatgtctgatatttaaataggaaatcagacaaacaatattcagaaagtttaagcatataaactttttatttttaacttgcctaaatccctgtattccaaaacctgctgcatcataataaatatatctatatatatttagcataagacgtgatatttttaatttcttttttaaaaaattatatttgtctcttagagttaaaattttctttatataatattgtcatatgtcatagttttaatacaattcacatgatttctatgtttcttaatgatattttgttgtgtaaaattgatcggattgattaaaaaacaaattctctgg

SEQ ID NO: 22517 - DNA, 1592 bp, Homo sapiens
agaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttgaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 22518 - DNA, 1743 bp, Homo sapiens
ccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 22519 - DNA, 2255 bp, Homo sapiens
agtccctcgccgagccgcgtggtgcactgaagccggcgtggggaggagagccgatgaaggagaacgctaacatgggggctccaggcagaatctctaatgggagagatttaggacctgagggagccgggagacccgggagcccacggtctggtcggccacctcctctcctccccgggcgcgaggcctatgagaccgcaagccaccctccaagaatgcgcgtgcagtcgttgccgtggcaacgtgcaagcctgcatgggcccaccgctaaaggaaaggggaggttgttgggggtgtgggggctggtcccctggaggtccaaactcatcacgcggcggtagcacgagggaactgggaacgtcccctcccccgtgtcccaaatcctctgggagccagaacgcaagtcgcatcgcctctctgagcctcagtttccacatctgccatatggaggcaagattattggttccaagttccccgaagagttatctggagggtaacgatccaggctagttcccacttatggttggacgtccaaggaatgggtttaagcggctcagataactcctgcgaccccaccccacccccaggcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgaggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccacc

SEQ ID NO: 22520 - DNA, 2255 bp, Homo sapiens; identical to SEQ ID NO: 22519

SEQ ID NO: 22521 - DNA, 1530 bp, Homo sapiens
atgtagagggggccaagaaggaagcaggaccagtggatgtgaggcgtggtcgaagaacaacagaaagggtgaaggtcacagagctgcaactgacatcttccgagctcgatttccagccacagcaggagctgatgcttcaaatcaccaatgcctccttggggctgcgcttccggagacagctgctctactggttcttctatgatgggggctacatcaacgcctcagctgagggtgtgtccatccgcactggtctggagctctcccgggatcccgctggacggatgaaagtgtccaatgtctcctgccaggcctctgtctccagaatgcacgcggccttcgggggaaccttcaagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtacccaatttaattccataatcaatctatcaattacagtccgtccaccacc

SEQ ID NO: 22522 - DNA, 1420 bp, Homo sapiens
gccagaccccgtcgcccggatcccctgagctgcccgccatcccacgtgaccgcgccgccccccagctccaccgctgagcccgctcgccatggccctcttcggggccctcttcctagcgctgctggcaggcgcacatgcagagttcccaggctgcaagatccgcgtcacctccaaggcgctggagctggtgaagcaggaggggctgcgctttctggagcaagagctggagactatcaccattccggacctgcggggcaaagaaggccacttctactacaacatctctgagaaggtgtatgattttctctccacgttcatcacctcagggatgcgcttcctcctcaaccagcagatctgccctgtcctctaccacgcagggacggtcctgctcaactccctcctggacaccgtgcctgtgcgcagttctgtggacgagcttgttggcattgactattccctcatgaaggatcctgtggcttccaccagcaacctggacatggacttccggggggccttcttccccctgactgagaggaactggagcctccccaaccgggcagtggagccccagctgcaggaggaagagcggatggtgtatgtggccttctctgagttcttcttcgactctgccatggagagctacttccgggcgggggccctgcagctgttgctggtgggggacaaggtgccccacgacctggacatgctgctgagggccacctactttgggagcattgtcctgctgagcccagcagtgattgactccccattgaagctggagctgcgggtcctggccccaccgcgctgcaccatcaagccctctggcaccaccatctctgtcactgctagcgtcaccattgccctggtcccaccagaccagcctgaggtccagctgtccagcatgactatggacgcccgtctcagcgccaagatggctctccgggggaaggccctgcgcacgcagctggacctgcgcaggttccgaatctattccaaccattctgcactggagtcgctggctctgatcccattacaggcccctctgaagaccatgctgcagattggggtgatgcccatgctcaatgagcggacctggcgtggggtgcagatcccactacctgagggcatcaactttgtgcatgaggtggtgacgaaccatgcgggattcctcaccatcggggctgatctccactttgccaaagggctgcgagaggtgattgagaagaaccggcctgctgatgtcagggcgtccactgcccccacaccgtccacagcagctgtctgagccctcaatccccaagctggcagctgtcattcaggaccccaacccctctcagcccctcttttcccacattcatagcctgtagtgccccctctaacccccagtgccacagagaagacgggatttgaagctgtaccc

SEQ ID NO: 22523 - DNA, 1298 bp, Homo sapiens
aatgccccgccccgtcagcacttatccctgagctgcttctgccgttgcatcttcgggactccgccccgcgcgcggacctgcagccatggcagtcaccgcccaggcagcccgcaggaaggagcgcgtcctctgcctgtttgacgtggacgggaccctcacgccggctcgccagaaaattgaccctgaggtggccgccttcctgcagaagctacgaagtagagtgcagatcggtgtggtgggcggctctgactactgtaagatcgctgagcagctgggtgacggggatgaagtcattgagaagtttgattatgtgtttgccgagaacgggacggtgcagtataagcacggacgactgctctccaagcagaccatccagaaccacctgggggaggagctgctgcaggacttgatcaacttctgcctcagctacatggccctgctcaggctgcccaagaagcgtggaaccttcatcgagttccggaatggcatgctgaacatctcgcccatcggccggagctgcaccctggaggagaggatcgagttctccgaactggacaagaaagagaagatccgggagaagttcgtggaagccctgaaaacagagtttgctggcaaagggctgaggttctctcgaggaggcatgatcagctttgacgtcttccccgagggctgggacaagcgctactgcctggatagcctggaccaggacagcttcgacaccatccacttctttgggaacgagactagccctggtgggaacgactttgagatctttgccgacccccggactgttggccacagcgtggtgtctcctcaggacacggtgcagcgatgccgggagattttcttcccagagacagctcatgaggcgtgaccggggcccacatctgtgtgtcgtgacttctgaagagtttggcctaggcctaaagagaggtcctggtgttggatagatgccagggcccctcctctggcccaggacgcctgctgcaagcccacccagatggggccagagtctgtgtggacaaccgtccccagccagtctgctcctagtggcactggcttcgtcctcccagggcccagagtgttccccatgctccacctggtggcccaggccacagctgctgcttgtatttcggtacagaagaggtttctttctgcaccaggaggaggcgtgctcaagtatcggtacgagatctagcctgccctgcctgcctgccctgggcgatgaggtacggtggggaaggtgcctattttagagaactttgtcacagtattaaagttcccagaacaaagtaggt

SEQ ID NO: 22524 - DNA, 2313 bp, Homo sapiens
ccggaagttccgggccgagttcctcgtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgtggttgaaaaatacgattatgtgtttccagaaaatggcttggtagcatacaaagatgggaaactcttgtgtagacagaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaaggtcttccccacccacccccagccccctagtctaatacccaccctgatacgtgcaatcatgtagttttggcggaaatttccccatcattctaggatgatacagaaagaaaaactgtgcctggaccctccctcttggtgggtctgtggaaacataagcggtttttttaatgggcccctgcatcaataccaaacatgggggtttggtaatgagaaaccaggacaggccatctgcagtgacccagcccaggacgaagtttacaaacacctcctggaacgaagctcccgcctgcatgtcaccttgatgggggctgtgagtggggcagtgtgatacccagtgactagacgcactctgcgttttcccgtgtttggggctgaggcctgctggacagatggctggccaagtgggagcagaccctagggagtttgcacctcggctgggccggattcggaccggctctgtgttcactacactcagaatagcctggctgcttctctgtctccgagaccggaggtagtgggaaccaacagctgggctggagagttggtgctggcaaaacagtccttgccctggggccggttcttacccaggtccagagaaaccaacgcgggatgtcagacttcaccaaaaggactttctggttgcccctggctggcttcctggaggcgttcgcctctagtttctcagggatggagcgagagcccagccagagaacagtaagaggagctgctctcctatctgcactcacccaggccttcacccagactttaccacggaggcggctgagtgcagctacagctaggtccgcgtccctcactcttttcatcttctgcacgttcttcgtgaaactggaaggatcccgggtctcagctagaacacggtggaagagaactttcctaggaaacggttcatgtgtcacttttcaggatgtggaaacactgagccatacaccctccattgcttggtgctggggttgtgtggcctccactgggcacttgccgacctgagtctggggccaggggagcccaggctgccctgcactcctgcctcccagcccacagccaggtgctttcatcacagctaaacctggttccctccaaacctcccagccactcgggcttgtaactgtctgagccccggatccggtggggtgaaagcagccagctcatcccagtgactcacaggacacagccatccagcggcatctttccttgtcgaatgatactgtaatgaccttccaaagtgaagagtagcacattaaagtgattttattgtttcctgt

SEQ ID NO: 22525 - DNA, 793 bp, Homo sapiens
gctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggccc

SEQ ID NO: 22526 - DNA, 931 bp, Homo sapiens
gtgccaacgtgtcttgtaaggtgcggctagaaactggggacatggcagcgcctggcccagcgctctgcctcttcgacgtggatgggaccctcaccgccccgcggcagaaaattaccaaagaaatggatgacttcctacaaaaattgaggcagaagatcaaaatcggagtggtaggcggatcggactttgagaaagtgcaggagcaactgggaaatgatgaatattcaaagtcatctgggtgaggccctaatccaagatttaatcaactactgtctgagctacattgcgaaaattaaactcccgaagaagaggggtactttcattgaattccgaaatgggatgttaaacgtgtcccctattggaagaagctgcagccaagaagaacgcattgagttctacgaactcgataaaaaagaaaatataagacaaaagtttgtagcagatctacggaaagagtttgctggaaaaggcctcacgttttccataggaggccagatcagctttgatgtctttcctgatggatgggacaagagatactgtctgcgacatgtggaaaatgacggttataagaccatttatttctttggagacaaaactatgccaggtggcaatgaccatgagatcttcacagaccccagaaccatgggctactccgtgacagcgcctgaggacacgcgcaggatctgtgaactgctgttctcctaacgtgggagcgggaggggcggggtcccggctgacaagccagcatagggcattcggtggccagagccgagggtcctcccacacgtgctcacccacccgcagcctaggcaggctctgcatgctatgccaggcatgtgcagtctggacttccacctccagtgccagaaacttccagaaggaaggagaaaactcttgtcaagaatggcccagaggaatgcctcgcacaaaa

SEQ ID NO: 22527 - DNA, 1280 bp, Homo sapiens
gaaggttctgggcggggctggactgttctaagtgagttcgggtgggggagcttcacgaggggaggctgctctgtgaaggaaccgcctttctctccgcgtgtctcacccttttctccccatatctgtttggacatgagctgagggcacggtcgcgggcggtcagccctgttcgcagctacggcgaggaggggcgcgattgttccttgttgccgctccgcttagtggccgcgtccattccgcgcggtgtcccgattttaggggtagggagaagtgtcagcttcaggcatcgcgaggcgtggcggccccatggccccgctgggaggcgccccgcggctggtactgctgttcagcggcaagaggaaatccgggaaggacttcgtgaccgaggcgctgcagagcagacttggagctgatgtctgtgctgtcctccggctctctggtccactcaaggaacagtatgctcaggagcatggcttgaacttccagagactcctggacaccagcacctacaaggaggcctttcggaaggacatgatccgctggggagaggagaaacgccaggctgacccaggcttcttttgcaggaagattgtggagggcatctcccagcccatctggctggtgagtgacacacggagagtgtctgacatccagtggtttcgggaggcctatggggccgtgacgcagacggtccgcgttgtagcgttggagcagagccgacagcagcggggctgggtgttcacgccaggggtggacgatgctgagtcagaatgtggcctggacaacttcggggactttgactgggtcatcgagaaccatggagttgaacagcgcctggaggagcagttggagaacctgatagaatttatccgctccagactttagtcactaggttctaggagtgagctggggcctgctgaggtgggggtggggctgactctgcaaaatgggggtgtcccccgatcctggccgaggtgaggaacagacagggggggtctagattctgagggggttggtggatattgggcaaggcaggaaacctctggagacctcattttctccatggggaagacagccatgctcttcaggaggagactccaagggcaaaggagggtgtcttggctgtgcttgaaggcgaaaccctgccatatccccagtgccagtcccctcagcctgtggtggccttgcatcctgactggatgttctcagccccttgttctgggcaagaacccagagctccccagtgtggatactaataaacctcttggagcacactctca

SEQ ID NO: 22528 - DNA, 2250 bp, Homo sapiens
agtcagattccgcgggagagcggcagagataccgcgatatttgggagcggccccgagacgcgcctggcgcggatcctaaatcccgacagctttatagagcccaggcctggcaggctcccagaacttgaagccaccagaccccacatggaaccaaaggcctcctgtccagctgctgcacccttgatggagagaaaattccatgttcttgtgggtgtcacggggagtgtcgcagccctgaagttgcctcttctggtgtcaaagcttttggacattcctgggctggaagtagcagtggtcacaactgagagagccaaacatttctacagcccccaggacattcctgtcaccctctacagcgacgctgatgaatgggagatatggaagagccgctctgacccagttctgcacattgacctgcggaggtgggcagacctcctgctggtggctcctcttgatgccaacactctggggaaggtggccagtggcatctgtgacaacttgcttacctgcgtcatgcgggcctgggaccgcagcaagcccctgctcttctgcccggccatgaacaccgccatgtgggagcacccgatcacagcgcagcaggtagaccagctcaaggcctttggctatgtcgagatcccctgtgtggccaagaagctggtgtgcggagatgaaggtctcggggccatggctgaagtggggaccatcgtggacaaagtgaaagaagtcctcttccagcacagtggcttccagcagagttgacctgggatttctgtcatgggtgtccctctgtactcagaatgggttcaggccaagtcggtgaagatggatgttggcaaaataggaggataccctcatttgctgaatgggggacctgctctgagcctgcccaggggccaggcctgctccaggttaaactggacggaaggcccaggtctcagtttctttcaaccaggagaggccgctgcctagagcccctccccaccttttcctggatgggtgaggcaagccaggagagcaagcagtgttgtcctcacgggaggaggactgagcgactgggaaaactcggctctacatctcacccagaacggcttttagaaacaccacagctggagagtcctggctgagccttgggagtttcagctctttggcggggtgcccaggtgccatgcgatcagcgaagcctgcgagttggcaggactctgaggtttcctgcagaccatgccatgagattgaaggtgcggggaaataaagaaaaatcaccatttaggagactccattctttccctacaacccagctgtggtcccagagatcagggggtgttgccaggtgtggctggggaagggtctgggttcacaactcaccggcactctttagtccccgtataacatggtggttaaggataaagatctgaagccagacagcccctagttccaatcccagctctgccgcttactagcagtggcagtttggttcaggacttagccttcctgaccttcacttacctcagctatcttgttatcctaccctcagggagttgttgagaggattcagtgaaattttgtgtgcagaatacccatgccactgagtgcctggaacgtagtaaatgtcaaatcaatggaagttaaaactaggcatgcatatatgccagagagctttcctagcatttactgcaatgccctgtctcattttgggaaaaaggaaatcctggatgctaagttgacacatccctttatgcaagtgacaggtaagcagccaggagggttgaccctgccctgggtcccaggcctcttgcctgcttcttggtttcctctgttctcatcctttcagctttgctggacctgaggcaggggcctgggtgtctgtgcctccctaccccccagtacacatgaccaagggaagtagatccagagacaccatgcactctggcccagaaaccctctgctacccagcttttgacttaattgccatttggtgtggctgcagcggggagggcttgtctgcgtatttggagctgaggctgaggctggcttcctgccctctggcttccaggccaggtgtgagggacatcccatgtgggctctgagagcactgagagtagaggtgccttgaggggaccaggaagcctactggctggaatcagtgctccagcagcctccacagcctttatctcaacagcacttgacttcaccaggtgaccctttgggataaaattgccttagggtatgaaataaactataactaaaatggta

SEQ ID NO: 22529 - DNA, 984 bp, Homo sapiens
tgcagatggcggaaatggatccggtagccgagttcccccagcctcccggtgctgcgcgctgggctgaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaagg

SEQ ID NO: 22530 - DNA, 793 bp, Homo sapiens
gcgcaggcgccggccgctgcgctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcaggtgatgggcgcttctcttccagagatctaatcccatataaccaatcttgggttaatttcctcttgatctggagatggcctttctgcatctgtattcgctaggcacaggggatacagagatgaataagacaccgccctccctcatggacctcaca

SEQ ID NO: 22531 - DNA, 1431 bp, Homo sapiens
gctgcagatggcggaaatggatccggtagccgagttcccccagcctcccggtgctgcgcgctgggctgaggttatggctcgcttcgcggccaggctgggcgcgcagggccggcgggtggtgttggttacgtcaggcggcaccaaggtcccactggaagcgcggccggtgcgcttcctggacaacttcagcagcgggcggcgcggtgcaacctcggccgaggccttcctagccgccggctacggggtcctgttcttgtatcgcgctcgctctgccttcccctatgcccaccgcttcccaccccagacttggctgtccgctctgcggccttcgggcccagccctttcgggcttgctgagcctggaggccgaggagaatgcacttccgggttttgctgaggctctgaggagctaccaggaggctgcggctgcaggcaccttcctggcagtagagttcaccactttggcggactatttgcatctgttgcaggctgcggcccaggcactcaatccgctaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaagg

SEQ ID NO: 22532 - DNA, 966 bp, Homo sapiens
gggacgtgactcgactaacatctgggtgtattgctgaagttggaaaaggggaagaaagaaagaaaaagcagcacaaaacccacaagtcccacgggtcaaatggccgagaaacgactcccaaggagtccaagtccagaaaggcccgtacagtggccggtaagggtcaaacatggccagttcttcacccaggctaggaaacgaacgtgagggaacgtgaccctaccagatgcccacccagccggggatccccctcgttgcagtgtcactttcgctgggctctggggcagaacaactacgcatttccagacttggcgagatcgggacctagtgtcaaaagaagggtagtgaaccgcccactcagtacggcgcggcgcgtacaccaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaa

SEQ ID NO: 22533 - DNA, 1044 bp, Homo sapiens
aggcgagaaggggcgtggcgcggcggccgcgaaacgtgcgcaggcgccggccgctgcgctgcagatggcggaaatggatccggtagccgagttcccccagcctcccggtgctgcgcgctgggctgaggcccttctgcgatgttttacctggctgcggctgtgtcagatttctatgttcctgtctctgaaatgcctgaacacaagatccagtcatctgggggcccactgcagataacaatgaagatggtgccaaaactgctttctcctttggttaaagattgggctcccaaagcatttataatttcctttaagttggagactgaccccgccattgtaattaatcgagctcggaaggctttggaaatttatcagcatcaagtggtggtggctaatatccttgagtcacgacagtcctttgtgtttattgtaaccaaagactcggaaaccaagttattgctatcagaggaagaaatagaaaaaggcgtagagatagaagagaagatagtggataatcttcagtctcgacacacagcttttataggtgacagaaactgaagtaaaaagcccttataggatcaaaaattgttcagggctcttagagatggtgaaaactacaaaaaaaaccatggctttcatatggacagataaaatgaaagaaagggaaaaggcagtggtgtgtaggcaaatatggtttggcatttgtcttttaatgacacctgatatgatgtcattttgattttgaaattgaacactagaactgttaatcacctttaaaaagaagagcttattgggaattatatattccttaaaatatacatgggggcctgaatgtcagccatctttatactatagaaaaaggattatggatgcatgaatggtcatgctttggagatcaaatattggttgaatgcctatgtatgtcaggccctgtgctgagccatgaggattaaaaagatgaataaacatatcttgtttaggaaatggatgtataaaaaaatcaagtgcaataaagtgtgtgtccaaaagctgacacaatggaaagga

SEQ ID NO: 22534 - DNA, 2471 bp, Homo sapiens
catcaccggccagccgggtggagtgagcggcgctgggctcgggctccggctccgcgggcggaagaggcggcggcggcggcagaagcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 22535 - DNA, 2694 bp, Homo sapiens
gcggcggcggcggcggcgggagccgaggaggaggttccggacgctgcttaggaaccggggactcaggagtgcccgcgccctgagcgctcagctccagaggcgggatgctcaccccttcctaattgcagctccgaatattcagatggggacagtgaagcacagatctcaggagtcctaagtattcatggctaccactaagttggatagaatggcctccgcccagactgcctggtgatccctgagcagctctctgcactgctccagaaatcaggaggatttttcagagcccagagagcagatttctccacgagccctaaggaaatctgaatctctggtgaggaaagtgacatggaggatgaaggaaacaagctctgccaagccccaccatggccaggccagaccagcccagtcatggctgagtacgggaccctcctgcaagacctgaccaacaacatcacccttgaagatctagaacagctcaagtcggcctgcaaggaagacatccccagcgaaaagagtgaggagatcactactggcagtgcctggtttagcttcctggagagccacaacaagctggacaaagacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtccctttttgtctctcatgggcctagcataggtatgagccagggatcctttcctggtccctaagatcaaaccccatggagcagccagcgttagatgcccccacccacctgtactctggagagactgtgctgggaacatgtaccactgagcctgagatggggatgagggcagagagaggggagccccctcttccactcagttgttcctactcagactgttgcactctaaacctagggaggttgaagaatgagacccttaggttttaacacgaatcctgacaccaccatctatagggtcccaacttggttattgtaggcaaccttccctctctccttggtgaagaacatcccaagccagaaagaagttaactacagtgttttcctttgcaccgatccccaccccaattcaatcccggaagggacttacttaggaaacccttctttactagatatcctggccccctgggcttgtgaacacctcctagccacatcactacagtacagtgagtgaccccagcctcctgcctaccccaagatgcccctccccaccctgaccgtgctaactgtgtgtacatatatattctacatatatgtatattaaaactgcactgccatgtctgcccttttttgtggtgtctagcattaacttattgtctaggccagagcgggggtgggaggggaatgccacagtgaagggagtggcagaatcaaattgctacatagtccaaacaaaaaagaaggctttttcaaaaaacattaaattcacatgcagtctcagagactatttagacaaagttcaagttaggagcttttaggatgtgggagtaaaactttaatgggaggggagggctggctgctggaagaaggaagaagccagactggttagacagtactcttaactcctagcccagcctagcgtgccctgcccctctggccactgctgcagacacctgccttaacacacacacctctaggactccacagttttgccttaaaggaccttcccaagtctccctttccctgtctggcttctcccttaagaagagagagatacttgtagaattgggtggggggaatgagcatgaactgtccttccatttgggatatgttacattagagtgagagagagaataaggagcctttcttatggaagaaatgggagaagagagacagggttcttttcagcagagtctagtagtttctctgtaaggcaaaataatctaaaaagactaacctgcccacccactccttatattgctgtgagattgcccctatcttgtgctcttctgtctgcagtgtgcacggccttgttctaacccggaataaaggtgattgattgtattgcaactaa

SEQ ID NO: 22536 - DNA, 1021 bp, Homo sapiens
ctccggctccgcgggcggaagaggcggcggcggcggcagaagcggcggcggcggcggcgggagccgaggaggaggttccggacgctgcttaggaaccggggactcaggagtgcccgcgccctgagcgctcagctccagaggcgtcatggctgagtacgggaccctcctgcaagacctgaccaacaacatcacccttgaagatctagaacagctcaagtcggcctgcaaggaagacatccccagcgaaaagaacaacctctcctacattgagcacatctttgagatctcccgccgtcctgacctactcactatggtggttgactacagaacccgtgtgctgaagatctctgaggaggatgagctggacaccaagctaacccgtatccccagtgccaagaagtacaaagacattatccggcagccctctgaggaagagatcatcaaattggctcccccaccgaagaaggcctgagcaagggggaggaagaggaggaaggttggaccttcatcagaccactcccttcccccatcctccaggagagggggcaagggcaacccaccatctacccacttactaacctggtcctaacccccttactgtgcgcgtgtgtgtgcgtgtgcgcacgctctggctgtttgtctatatgtctagctcatctagttcctcttcttaaggggatgggggtcaggggctaggggagggggctgagtttccccactttaggaggaggtgggggctatttctatgcaaatagaaatcagcacattcctcctacttccctttcctccactccccccatatctttaaagtgtggaagcagaaaggacctgcattttcctacattgaggagctgacataggggtaaggtatgggagaggtaggtggatccagggaaaagcagtggggacggaaggcaaagagaccactcaacccccacctggaaggggcaaagaaaagccagagttccatgtttgtactcctgtgctggactgtttcctgagtaccagcaggtcccttttt

SEQ ID NO: 22537 - DNA, 3682 bp, Homo sapiens
agtagctggggccaccctcgggaaggaagagcctgtcgcgagcgcgagcttctgagctcgacgggccgagctggcagctggttggtgcttacaccttggccgcagcggcaggtccttccacgtgctttcggcggcgacatggagctggaggagttggggatccgagaggaatgtggcgtgttcgggtgcatcgcctcaggagagtggcccacgcagctggatgtaccgcatgtgatcactctgggactcgtggggctgcagcaccggggtcaggagagtgctggtattgtgactagtgatgggagttcggtgccaacattcaaatcacacaagggaatgggtcttgtaaatcacgtctttactgaagacaatttgaaaaaattatatgtttcaaatcttggaattggacacaccaggtatgccaccacaggaaaatgtgaactagaaaattgtcagcccttcgttgttgaaacacttcatgggaagatagctgtggcacataatggcgaattggtaaatgctgctcgattaaggaaaaagcttctgcgtcatggtattggtctgtctacaagttctgatagtgaaatgattacccagttactggcgtatacccctcctcaggaacaagatgacaccccagactgggtagccaggattaaaaacttgatgaaggaagcacccacagcatactccctgcttataatgcacagagatgttatttatgcagtacgagatccttatggaaatcgtcccttatgcattggtcgtcttattccagtgtctgatataaatgacaaagagaaaaaaacatcagaaacagaaggatgggtggtgtcttcagaatcttgtagcttcttatctattggtgcaagatattaccgtgaagtcttgcctggagaaattgtggaaatatccagacacaatgtccaaactcttgatattatatcaaggtctgaaggaaacccagtggctttttgtatctttgaatatgtttattttgcaagaccagacagtatgttcgaagaccaaatggtttatacagtaagataccgttgtggccagcagctagcgattgaagcacctgtggatgcagatttggttagcactgttccagaatctgctacgcctgctgctcttgcttacgcaggaaagtgtggacttccatatgtggaggtgctgtgtaaaaaccggtatgtagggagaaccttcattcagccaaacatgaggttaagacaacttggtgttgcaaaaaaatttggagtattgtcagacaactttaaaggcaaaagaattgttcttgtagatgattcaattgtcagaggcaataccatctcacctataataaaactgctcaaagaatctggtgcaaaagaggtacacattcgagtagcttcaccaccaattaaatatccatgcttcatgggaataaacattcctacaaaagaagagctcattgccaataaaccagaatttgatcaccttgcagaatatctaggagcaaacagtgttgtgtatctgtcagtagaaggactggtttcatctgtacaagaagggataaagtttaaaaaacagaaagagaaaaagcacgatattatgatccaagaaaatggaaatggtctggaatgttttgaaaagagtggtcattgtacagcttgtctcactggaaaatatcctgtagaattagaatggtagctggtagggttggatgtgtgtagtttcaagatagaaagttggtcaagaagttatagtggtcacacctcatctatttactgttactcagttggtacaatgtaaaatgccatgcttatgtttataagttttgagattttttttttttctgaaaaggataccaaagtgcgataactgaacatttccaattgcatataatacaacaatatgtggtgttcttttttttacacaagcattggctagcctttttaacctggtcagagaaggcaggtggtcactgacatttcccaagtccatgctttaaagggtttgcaagaagttagggttaaggagaggtgatgccaacaagacaggtgagttaaatataccatttcacacaaagtttgaatagaatacattatacctcataggtgtctagcctctacagttctggctgtagttatgaccttggcttccctgtctaactgtagacaaatctttaaaaaaaaataataataatctggtgcctcagtttccccacatgtgcaatgggatacttattaaataattaataagaatgtgaataagtgtcatacttttgtgatttgagccatcatttcacttctgattttaagacaactcatgattgttagctttcagaaagctaatgattgttaactttttgaaattagtttacaattaattaagatttcattatgatggaaggagacataattggcagatctttgccatctctctttgagatgtcctaaaaagggttgtaaaaatctgtgaaaaagtttttcctacatttgactagaaaatgtgatccatagtatttagtgccctgatactataagctcagcaagtaacctggtacatttgaaataaaaaccaaatttttagattcaaacaatccctttatccttaatttaattaattatcatatgctttttttaatgaagtgcttgatcacttgcaaacatatatacatgtagatgtacatatacatgtacacatacacataaatattattgcaattaagtgatcaagtacagacacaataggggccagttttgtttaaggatcaaagagacaaccactttggggaattagtatcaacttacaatccaagtccaagtatcatcttataatcacttttttctactatattaagatctaatgaatttgatttcttttttgaagttttttcttgtaacatctgagattagaagtttaagatgacttgaccccaaacctttgtttatgtaagaatttttaaacataaaagtgtttgtttctgttatgttaccataatttgatgtatatagtgtccagatccatttagaaatttaatatttattaataactgaaactgtttgtcttcctttggtatatagtctcgcatattatattatagcaggccaagataaaattttgacagctctttaagcccacatgcagcagtgggtcagataaccctgtggcagtgacacgggcaaattggcatttgaataaagccctgggaccacctcaacatgcgtagcctcttgtcttaaatgtactccccatggcagcatggaggaggcaagacctgtgggtcaattttgaactggccttactttgatttttaaaacaagagactcagggaaagtactaaaccaaaatctctgattttactttgcgttttctgtagtttttgttttactgagatgcttttgtaaaggaaaataatactgtgacagtttagtaattctacagattcttaatatttctccatcatggccttttacttcacaattttctgaagtctgaattcaattacaatttttttttaccaatttaatctcaaatgttgtttaactgctttaaattcatatacgtagagtattataaactgcagagatgaaaaatgtgttttcacgggatttatattgtgaactaaactaagcctactttttgtgacttatttgtgatgccttgttgataaatatgtgtaataagtatgtttaaa

SEQ ID NO: 22538 - DNA, 942 bp, Homo sapiens
aatcaatgacaatttaatggagcttttgatcatgattaatgcctgcaagattgcttcagccagccgggttactgcagtcatcccatgcttcccttatgcccggcaggataagaaagataagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttca

SEQ ID NO: 22539 - DNA, 628 bp, Homo sapiens
caacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcaggtatcagtggaagctaaatattggtgtttgaaaggtgggaggaaaggactgatgatgctgaagactgcagagaagccaaaaattatgcccaagtacatctgaaataaactagatatcaacaaca

SEQ ID NO: 22540 - DNA, 1218 bp, Homo sapiens
aagatggcggagtagcaacgcaaagcgcttggtattgagtctgatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgata

SEQ ID NO: 22541 - DNA, 2073 bp, Homo sapiens
gggaatgtaagatggcggagtagcaacgcaaagcgcttggtattgagtctgtggccgacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaacttctgaggctttttgagaataaaatccaccccacccttgtttccccttggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgtgggccttgcagctttaactatagctcagctgctgcaagatttcagacttttgaggatgttgtgtgagggtgtttgactgtgactggggaagctcagactactttgtatgtgaatgcttcagggttttctttgttgagaacaactagcaacaaaggcaacccatgtgtgaccagttctccccaaggtctatgctaaattatagcaagagccctgggcaaccccaaacctagtcctggtagctgagcaccctgtaaggcaggagcaggcagctcagcttgagcagacattgggtggggggtggggggtggttgaggggggaggcagcacagtgcagcaaatgtttcttgggaggaagaagcctgatccatcaccatctgcttgactatgtagcttggattctcctttgtacctatccctttcgatttggctttaccttcatctatcttgatcctttcctggccaaatatcctcttgggcccaaatgaacattgtaccatagtcttctggaaagcaaacatgcttcctgctatgtaattgctaacattcatattagatgatgtgctgtagcttgatcttccttagcctactgccactgaggcagtaggttttaggtggtatcgtagtgccttttgattaatttaagtatttaattttcatcttccttctttggatctatttggcctctcaaatgaactgagattcctgttaaaaaagattgatgttattgtctcttgtagaggaaactaataaagtgtgtgtacctgtgtga

SEQ ID NO: 22542 - DNA, 1199 bp, Homo sapiens
gacttcggttccggtctctgcagcagccgtgatcgcttagtggagtgcttagggtagttggccaggatgccgaatatcaaaatcttcagcggcagctcccaccaggacttatctcagaaaattgctgaccgcctgggcctggagctaggcaaggtggtgactaagaaattcagcaaccaggagacctgtgtggaaattggtgaaagtgtacgtggagaggatgtctacattgttcagagtggttgtggcgaaatcaatgacaatttaatggagcttttgatcatgattaatgcctgcaagattgcttcagccagccgggttactgcagtcatcccatgcttcccttatgcccggcaggataagaaagataagagccgggcgccaatctcagccaagcttgttgcaaatatgctatctgtagcaggtgcagatcatattatcaccatggacctacatgcttctcaaattcagggcttttttgatatcccagtagacaatttgtatgcagagccggctgtcctaaagtggataagggagaatatctctgagtggaggaactgcactattgtctcacctgatgctggtggagctaagagagtgacctccattgcagacaggctgaatgtggactttgccttgattcacaaagaacggaagaaggccaatgaagtggaccgcatggtgcttgtgggagatgtgaaggatcgggtggccatccttgtggatgacatggctgacacttgtggcacaatctgccatgcagctgacaaacttctctcagctggcgccaccagagtttatgccatcttgactcatggaatcttctccggtcctgctatttctcgcatcaacaacgcatgctttgaggcagtagtagtcaccaataccatacctcaggaggacaagatgaagcattgctccaaaatacaggtgattgacatctctatgatccttgcagaagccatcaggagaactcacaatggagaatccgtttcttacctattcagccatgtccctttataatagagtaaggtatttgatgacaaattcagcagaagacccggcttgctccagtgtagctttctacatcccacatcaggtatattagagcttatccgaactggggaaagacggattgagattaactgctgggacctcctacctgcattatctcattctggcttccttgataattctgt

SEQ ID NO: 22543 - DNA, 1082 bp, Homo sapiens
attagagtctgtgcttcacttccgttccagcctcagcggcagctggatcgctcgacggagtgcctctggtagttggccaagacgccgaatatcaaaatcttcagcggcagctcccaccaggacttatcccagaaaattgctgaccgcctgggcctggagctaggcaaggtggtgactaagaaattcagcaaccaggagacctgcgtggaaattgatgagagtgtgcgtggagaggatgtctacatcgttcagagtggttgtggcgaaatcaacgacagtctaatggagcttttgatcatgattaatgcctgcaagattgcttcagctagccgagttactgcagtcatcccatgcttcccttatgcccgacaggataagaaggataagagccggtccccaatctctgccaagcttgttgcaaatatgctctctatagcaggtgcggatcatatcatcaccatggacctacatgcttctcaaattcagggcttttttgatatcccagtagacaacttgtatgcagagccaactgtcctgaagtggataagggagaatatccctgagtggaagaactgcattattgtctcgccagatgctggtggagctaaaagagtgacctccattgcagaccagttgaatgtggactttgctttgattcataaagaacggaagaaggccaatgaagtggactgcatagtgctagtgggagatgtgaatgatcgtgtggctatccttgtagatgacatggcagacacttgtgttacaatctgcctcgcagctgacaaacttctctcagctggagcaaccagagtttatgctatcttgactcatggaatcttttctggcccagccatttctcgcatcaacactgcatgctttgaagcagtggtagtcaccaataccatacctcaagatgagaagatgaagcattgctccaaaatacgagtaattgacatctccatgatccttgcagaagccataaggagaactcataatggggaatctgtttcctacctgttcagccatgttcctttataacagaataacttctaggttatgctattttaaaataaaataagatt

SEQ ID NO: 22544 - DNA, 2511 bp, Homo sapiens
cctccccttccctacatctagccgccgcgctttcccgctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctttcagtactttgaggcgacaactttcaagtatataatttcattgtggaagtcatagtttatatatttcgaggttgccaaaggtgacttcagattaaagccttctgtgtaaatatatactgataatgcctatggacatttgggtaaaaccctgtatagaattaattatccttttactttggagtgaaccttggaaaatttataattataataccatggattttgaattttccttttttttttttttttggataactcagtttcagataaaccatcttggttactgtgcttaatttggaccaaattttatttagcttaatatggacactgacacattttggggggtatacattagacatatcagagcagtgtatttctggatcattttttaaatgacctcttctaaaacataactgtcacttacctgaaatgctgcatcctaaaattccaaaattatattgagcaatcgccaaggcctaaagccaactgacttaaaggtaatcatttcagctaagattaaatttaaagcctaagaatgtatagagctagttttaaaataatgatctcagatttttaaaaaggatataggaacctgcattgtcattctctgaattaagaactgatggtttctatcattatttagccccacctttgtattttaaaatccttcagaatacatttatgaaccaatgcgactggacttagccacacacaatggaaattcagaccttgactatttggtgtttccagttcacaaaggtgatgaagactgtcttgggagcagcttaatcccaaaatttgtacatttcttgctgctcctggcgtggaaacttaagtgagaccaccaaatacattggtcctgtccaattctactgaatgggggtggacctggcatttatctggccaaaaacaggagccagagaaatatgaatataccaaagttgtttgtttagcctccaacttaaattacattagtcaacttatagatactcatatgatcacttttctttttagatactacatcaactagattcaggagtatatcatttgcagtgcttgtattggtttaaaatgtaagattttaagatcctctaacactgtactaaaacatttcaataaaatcattctgactgcgttca

SEQ ID NO: 22545 - DNA, 1348 bp, Homo sapiens
gctcccgcagcagcagcctcccgcgtcgctgtcgctgttgcctccgccacctcctccgccgccgcgcgcccctcggagttccgcgccccaccatgcccaacatcgtgctgttcagcggcagctcgcatcaggacctgtcccagcgcgtggccgaccgcctgggcctggagctgggcaaggtggtcacgaagaagttcagcaaccaggagaccagcgtggagattggtgaaagcgtgagaggggaagatgtctacatcatccagagcggctgcggggaaattaacgacaacctgatggaactcctcatcatgatcaatgcctgcaagattgcgtcatcatccagagtaactgccgtgatcccgtgtttcccatacgcccgacaagataaaaaggacaaggtaggagagagtcgtgccccaatttctgcaaaacttgtggccaatatgctgtcggtggctggggcggatcacatcatcaccatggacctgcatgcttctcagatacagggattctttgatattcctgtggataatttgtatgcggagcccgcagtcctgcagtggattcgggaaaacattgccgagtggaagaactgtatcattgtttcacctgacgcagggggagccaaaagggttacatcaattgcagacaggttgaatgtggaatttgctttgatccacaaagagaggaagaaggcgaatgaagtggaccggatggtcctggtgggcgacgtgaaggaccgtgtggccatcctcgtggatgacatggctgacacttgcggcaccatctgccatgctgcggacaagctgctgtcagctggagccaccaaagtgtatgctatccttacccatgggatcttctctggaccagctatttccagaataaataatgccgcctttgaggctgttgtcgtcacaaacacaattccgcaagaggacaaaatgaaacactgcaccaagattcaggtcattgacatttccatgatcttggccgaagcaatccgaaggacacacaatggggaatccgtgtcctacctgttcagccatgtcccgctataaatccagaatgggaagtgtccagcaagcctactctgacttctgacttgtttttgttttctggatttttagctgtaggtattcagcaatgataggttaatcactggcaaaagcatcagatctttgtatatgctaagatttattgtttccccttctaaagctcaagatcatttctttccagtttttggggaaatggtggtggttatttggtctttaagtgaactgtcttaaatgagaaacgtttttgtcattttgacttttaacaggtacaggtgatctcttcctttgttctt

SEQ ID NO: 22546 - DNA, 1678 bp, Homo sapiens
agagctagatcgtatacctcctcggaggcggacatgttgggtcctggccaaaaagttggaaacacctggggccactaccgaggcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgt

SEQ ID NO: 22547 - DNA, 2213 bp, Homo sapiens
aaaaagttggaaacacctggggccactaccgaggtaggctgctcctcccaagaaagtgagaccgaaagagctcccgtggaagcggtcaaagcaggggcggggcgaacctgtgacatgcccctcggaagaacaggcttttagagagtcgccaggctccctgccctcatccgagatggcggcctgagggcgctctagccgacgctcttcggatgcccggagggggcggtggccttgcctctggctctgaggcggcggcgccgggcgctgcgaaggctcggccgctgtagtcagtggtgtggggtgcgcaagggcacggacctcggagctctccccgcttgcgccgagtttctcagcgccttccccacccaaaccggggtctcgcagtcggaagcactcagagtgcagccccgcgcggggccggtcgtaaccgcgccgcgggccggacgatgcccaagaagctgctgctgttgcccccgccctccgcgtcctcggctttccgcgtcccgcgcgcccgccccgttcccccgccggccatgaacgccgctcgcaccggctaccgagtcttctcggccaactccacggccgcctgcacggagctggccaagcgcatcacagagcgccttggtgctgaattggggaagtctgttgtatatcaagagaccaatggagaaacaagagttgaaataaaagaatctgttcgtggccaagatattttcattatacagacaatacccagagatgtgaatacagctgtgatggagttgctcatcatggcttacgcactgaagactgcctgtgccaggaacattattggggtcatcccctacttcccctacagcaagcagagcaagatgaggaagaggggttccattgtgtgcaagctgctagcatccatgctggcgaaagcaggtttaactcacattatcactatggatcttcatcaaaaggaaatacaaggctttttcagctttcctgtggacaaccttagagcctcacctttcctgcttcagtatatccaggaagaaattccaaattacagaaatgcagtcattgtagctaagtctcctgatgctgcaaagagggcccagtcctatgcggagagactgcgtctgggtttggccgtcattcacggggaagctcagtgcacggaactggacatggacgatggtcgtcactccccgcctatggtcaaaaatgctactgtgcacccaggcctggagttgccattgatgatggccaaagagaagccaccgataactgtagttggagatgttggaggccgcatcgcaatcatcgtggatgacattattgacgatgtggagagttttgttgctgccgcggagatcctgaaagagagaggcgcctataagatctatgttatggccacccacggcatcctgtctgcagaggcccctcgcctgattgaggagtcctccgtagacgaggtggtggtgacgaatactgtccctcatgaggttcagaagctgcaatgtcccaagataaagactgtggatatcagtttgattctttctgaagccattcggagaatccacaatggagagtccatggcctaccttttccgaaacatcactgtggatgactagctttcacgagggtctcgaccctggacctcctgagggaaacatggaaaaagcagtgccatgagtgatacagtgtttccttgcaagggaggactcgaaacagcctggagttagatatcttcttttgcccggattgatggggaggagggattaaaagagtcaggaagaagacagagctaatggataaatatcataacatggccttacatgtctgctgtcatcagccctgttccttaaaagttctagctgctttcttaaaaataatctgaaaatcttattgatactaaagaggagttaaaggcacataaagtcttaactctataatgttcatttagttgtttcagctccagggaaatggaggtattgatgttgaacctggttagggaagctgagcgcctgtggccctattactatccagttggcctctcccaaatcaacttcaagtcttttatagagaatcgtatttttctttcagaaattgttatgcctacagccattgaaaaatgaagcattcatgttgttacatcttccaaggatgtcagattagaaaatagcatcccacctctgggtatctgagtggctctgaagttgcaaataaaataatttgttgtc

SEQ ID NO: 22548 - DNA, 1890 bp, Homo sapiens
ctagagaggccgccaggagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatct

SEQ ID NO: 22549 - DNA, 2092 bp, Homo sapiens
gccagccacagcagagaggtgggggttgtgaccggagttagatgccagcgcagaagggacgtgagcccagccgaggtaccgctgaagaggaatcaattttggtatgcagataatcactgggctcatgggtcttgctctttacaaagagaattcagcggggtgccaagtcgttttctgtgtgggttgagagacaggctgtgcagcccactgttgcataggactaactactacaaatcatgctgagaccgagctatttttgctgcttagaggctttgcagccttgagaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatcta

SEQ ID NO: 22550 - DNA, 968 bp, Homo sapiens
cgcagtcaccgcggacgccaatcttgtgcatggagtcgccattttgctcctagagaggccgccaggagacccggcgctttcttccttctgcagctgaggctgcggcggggccggggctggggtcggggccaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtg

SEQ ID NO: 22551 - DNA, 787 bp, Homo sapiens
gccagccacagcagagaggtgggggttgtgaccggagttagatgccagcgcagaagggacgtgagcccagccgaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagag

SEQ ID NO: 22552 - DNA, 1491 bp, Homo sapiens
gttgtgaccggagttagatgccagcgcagaagggacgtgagcccagccgaggtaccgctgaagaggaatcaattttggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaag

SEQ ID NO: 22553 - DNA, 883 bp, Homo sapiens
ttttgctcctagagaggccgccaggagacccggcgctttcttccttctgcagctgaggctgcggcggggccggggctggggtcggggccagaattcagcggggtgccaagtcgttttctgtgtgggttgagagacaggctgtgcagcccactgttgcataggactaactactacaaatcatgctgagaccgagctatttttgctgcttagaggctttgcagccttgagaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagag

SEQ ID NO: 22554 - DNA, 1038 bp, Homo sapiens
agtctctgctgcctggaccttaaattctgatggggaaatctttttaccaaggttatatctcttgtctggaaggtaaaggctgaggcccagcaaggacaagtgatgtccacatggcctagtagctggaaggcaaacccaactcttcacactcctacttcagccatctttaagtagaaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatcccca

SEQ ID NO: 22555 - DNA, 325 bp, Homo sapiens
aagaggaatcaattttggtatgcagataatcactgggctcatgggtcttgctctttacaaagaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtgg

SEQ ID NO: 22556 - DNA, 931 bp, Homo sapiens
aagggacgtgagcccagccgaggtaccgctgaagaggaatcaattttggtatgcagataatcactgggctcatgggtcttgctctttacaaagaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtg

SEQ ID NO: 22557 - DNA, 700 bp, Homo sapiens
atctacatgaagaattacagcaagacatgcaaaagtttaagaatgaggtcaacacattagaagaagagttcctggctttgaagaaagaaaatgttcaacttcataaagaggttgaagaagaaatggagaagcacagaagtaatagcacagaattatcaggaaccctaactgatggtactactgttggcaatgatgatgatggactaaatcagcagattcctaggaaggaaaatgaagagcatgacaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactc

SEQ ID NO: 22558 - DNA, 1087 bp, Homo sapiens
cgcccctccccgcccaccggcctcgcagtcaccgcggacgccaatcttgtgcatggagtcgccattttgctcctagagaggccgccaggagacccggcgctttcttccttctgcagctgaggctgcggcggggccggggctggggtcggggccaggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtg

SEQ ID NO: 22559 - DNA, 1494 bp, Homo sapiens
agaggccgccaggagacccggcgctttcttccttctgcagctgaggctgcggcggggccggggctggggtcggggccaggctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgc

SEQ ID NO: 22560 - DNA, 1047 bp, Homo sapiens
cagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagagcggctaggggtggagatgggcaaagtgcaggtttaccaggaacctaacagagaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactgg

SEQ ID NO: 22561 - DNA, 1835 bp, Homo sapiens
ggggttgtgaccggagttagatgccagcgcagaagggacgtgagcccagccgaggtaccgctgaagaggaatcaattttggaggaattttgttgtcagagaataaaaggaggttgtccataattgactttaagcagcaatcagtaaaacattgagctcttcagctccgcctttcttgctctgaaaattggaaaaccaagaaggttttgatgttttgtgtgacgccacctgaattagaaaccaagatgaacataaccaaaggtggtctggtgttgttttcagcaaactcgaattcatcatgtatggagctatcaaagaaaattgcagaaaacaagagtacaaattcaagagtctgtgaggggaaaagatgttttcatcatccaaactgtttcgaaggacgtgaacaccaccatcatggagctcctgatcatggtgtatgcatgtaagacctcttgtgccaagagcatcattggcgtgataccctactttccttacagcaagcagtgcaagatgagaaaaagaggctccattgtctctaaattgctggcttccatgatgtgcaaagctggtctaactcatcttattactatggatttacaccagaaggaaattcagggcttcttcaatattcctgttgacaatttaagagcatctcccttcttattacagtatattcaagaagagatcccagattacaggaatgcagtaatcgtggccaagtctccagcctcggcgaagagggcacagtcttttgctgagcgcctgcgcctgggaattgcagtgattcatggagaggcgcaggatgccgagtcggacttggtggatggacggcattccccacccatggtcagaagtgtggctgccatccaccccagcctggagatccccatgctgattcctaaagaaaagcccccaatcacggttgtgggtgatgttggaggaaggattgccatcatcgtggatgacatcattgatgatgttgacagctttcttgctgcagcagagaccctgaaggaaagaggtgcatataagatctttgtgatggcaactcatggcttgttgtcttctgacgccccccggcggattgaagagtctgccattgatgaggtggtggtcaccaatacaattccacatgaagtccagaagctccagtgccccaagattaaaactgtggatatcagcatgatcctttcagaggcgatccgtcggatccacaatggggagtccatgtcctaccttttcagaaacataggcttagatgactgagttttcctttaggaaaactcccgagggccaaactggaaacataagagtgactgctcggtgggatggatttcacaggaaccgtcatgcttgttcctccctctcccctgtaacctcacttcttattgattcctaagaagatagaccaactttttatgtcggtttgggtgtttgtgagtttggggagcaatttttataaaagaaaaactttattctcctcttttgaaaaggtaagacctcgttttagttgtaactgtttaaaaaataacacttggaataagatttgtaagctcacaaagccttcttccaaagttgcttgagccaagtgcttaaaaagttaataaaataaaatgatctgtatgatacctgcaattgaaaagccgaaaagattatactgtcaagtccagtaaatgacatttttagagatgcttttgtagacaagcatatggaatatgtgattgtatttattttctgcaactaaaaaaggaataaaaacttgtgtttgtgtgtttttctaaaactttgtgttttggcaatcgttttataactaaaataaaatgaaagctaaatcta

SEQ ID NO: 22562 - DNA, 1926 bp, Homo sapiens
cttcccttcccgcgttccccgggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactatgctggatttgagattccaaacttatttgtggtgggatatgccttagattacaatgaatacttcagagatctgaatcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagagctttcttttctgaggttaatataaagagtatcaaaggttcctaaggaaaagaaagcagtgcttttatttgacttgttccaaattaaacactccgccttgtgactcagcaatgctatctaccttcacactcctgagctccgccttcctttgttttgatacagtcattatatttgattagtattcccaggaatacccccacctagttactcaaatatttttcacttaactttttatactcttattttggtaataagcttacaatattaagaagctggggacttttttttaactgaagacttgagtcccctataccgggaatgcagctattaatagattcccatattttaaaaggagggaaaggacaatttaatataaatttctgtttgtgcatttctgacaggccattattatctgctttgacaaagcctttctgaaacgcagtgtacaatgaatcttaatgatgttatgaaacgagctttgctcggggctcttgattggagcttccggtatgtgatgacggtatgtcatgtatgcatggatgtactcaactgtgtttaatactctgaattttaattagaaaaaaatacaatagcagcaaggccctggtttctaagctgtatccttttattcatgtgggacatgagcaaatggcagaattaggggcgagtgctttcaatgctcgaaactaagcaagtataaatttttcctcttatttgcatgaaaggacaagacactgttatgccctgtcctaaatgtgaagacagaggttgaattttttaaaaaatatctttaaaagactgatcacaaaatccaaggtgctacaggaaacaagcacactcaagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaactt

SEQ ID NO: 22563 - DNA, 1849 bp, Homo sapiens
cttcccttcccgcgttccccgggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagtctgtcctttttgcaaaggatgttgtcggaactgggaggaccatgaaagcactactcagcaatatagagaaatacaagcccaacatgattaaggtagccagtttgttggtgaagagaacatccagaagtgacggctttagacctgactcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagagctttcttttctgaggttaatataaagagtatcaaaggttcctaaggaaaagaaagcagtgcttttatttgacttgttccaaattaaacactccgccttgtgactcagcaatgctatctaccttcacactcctgagctccgccttcctttgttttgatacagtcattatatttgattagtattcccaggaatacccccacctagttactcaaatatttttcacttaactttttatactcttattttggtaataagcttacaatattaagaagctggggacttttttttaactgaagacttgagtcccctataccgggaatgcagctattaatagattcccatattttaaaaggagggaaaggacaatttaatataaatttctgtttgtgcatttctgacaggccattattatctgctttgacaaagcctttctgaaacgcagtgtacaatgaatcttaatgatgttatgaaacgagctttgctcggggctcttgattggagcttccggtatgtgatgacggtatgtcatgtatgcatggatgtactcaactgtgtttaatactctgaattttaattagaaaaaaatacaatagcagcaaggccctggtttctaagctgtatccttttattcatgtgggacatgagcaaatggcagaattaggggcgagtgctttcaatgctcgaaactaagcaagtataaatttttcctcttatttgcatgaaaggacaagacactgttatgccctgtcctaaatgtgaagacagaggttgaattttttaaaaaatatctttaaaagactgatcacaaaatccaaggtgctacaggaaacaagcacactcaagaaagtttttttctgaataacatttttttccaatttctccgttttataagacatttcctaatttatggggattttaattgaaaataaacttgagtcccaatagagctgtttttttctcacttcctacaaaatgcaaatgcaaaataaataactaagcagcttttgtttggttctgaaccgtatgtggcgtattgttattaggttctagcttcctttaaactaataaagaataagaaaactt

SEQ ID NO: 22564 - DNA, 741 bp, Homo sapiens
cgttccccgggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggctgcgtgctcggttgaagaggacaaccatctgtgatagaggaggactggccttcagtcaagggtatatgagtagctgtgctcccctgcaagaatctccaaataccctctggagaggttacctccaagtgctcattccctgtttccacatccggtttcagttaccaagatcagagcagaattaggtctgagatccagtgaggtgtacagtagcacctggaccattctagggctcactgtcttcaagccctggctgtgcccacagtcttcatgaagaaactggacactgtgtctgctggatgatgtatttcttcttgcttgaggttatgaaaaatatcaaaatatgtaaagaaacatgctggataaaaatattgccttgaaatacaa

SEQ ID NO: 22565 - DNA, 747 bp, Homo sapiens
gggagaaacatggccgggagcagcgaggaggcgccagactacgggcgaggcgtcgtgattatggatgattggccagggtatgacttgaatttattcacgtacccacagcactattatggagacttggagtatgtcctcatccctcatggtatcattgtggacagaattgagcggctggccaaggatattatgaaagacataggatatagtgacatcatggtcctgtgtgtgcttaaaggaggttacaaattctgtgctgatctcgtagaacaccttaagaacatcagccgaaattcagatcgatttgtctcaatgaaggttgatttcatcagactaaaaagttacaggaatgaccagtccatgggtgagatgcagataatcggaggcgatgatctttcaacgctggctggaaagaatgttctcattgttgaggatgttgtcggaactgggaggaccatgaaagcactactcagcaatatagagaaatacaagcccaacatgattaaggtagccagtttgttggtgaagagaacatccagaagtgacggctttagacctgactcacatatgcgtcatcaatgagcacggtaaagaaaaatatcgagtctaaagacatgaattctcaccactaaagtcccagatagcatcatatttacgcctgtacttgggaagccagctgtcaagtttgtccccccaggcatcttcactcagcaggatataaaagaaaaaaatgttcaaatgagagag

SEQ ID NO: 22566 - DNA, 3297 bp, Homo sapiens
agtctccgcccatacccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcagttacctcatataagtcaaatcgtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctagatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaa

SEQ ID NO: 22567 - DNA, 3339 bp, Homo sapiens
gctagccttcccctaagagctgcctggaaagctgtatttgctgcacgtggaaatctccgttattttccagcacccaacagtagcgtaatgggagtaacggacttaacctcatttctctttcagagcatttagccttcatatgcccttccctgcatgcttcccccaggccgtcaagacttgagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaatgcttctctagatccatattaataaacatgagcatctaacccctcctttcttaggctagacaccaagatatttcagccagcctttatcattcctcttactttatcctttttccttaagtattggtggtcactactattgagtttcttccttaacactgattaaatgatcttaactccctcagctaaaactggcattactgactcccagctatatttctccagacttgcatttttttttttttttttgagacagggtctcactgtcgcccaggctggagtgcagtggcgtgatctcagttcactgctgctttccctcctgggctcaagcagttctcccacctcagcctctcgactaacagggactataatcttgcagcaccatgccgagctaattttattttttgtagagatgagctctcactatgtcacccaggttcgtctcaaactcctgaaccctagtaattctcctatctcagcctcccaaagtgctagggttacagacatgagccactgtgcctgtctagacttgtactttcaactgtccatttctccctgtctgtcccatgggcactcatgaaaaaacagaatgctcccaactttattcatcttccaagcctgtagctcttggtatactcactgttgcaagtcagaagcttgatttcatcattgatgtttttctcacgtttcacatctcactcatcaccaagtcatgttggtgttaatttctgattaacccttgaatttaccgtcttctcatcctctgtacaaaagcctcaagtgagggtcaaattcaacattatcctgatctagacagcccccattctcaatccacccttttccaagttgattgcccaaggacttctaacaataaactctcttttgcaccacagacttctttgaaaatatacatgctgttgaccctctctgtagaaaaccgcacacataaaacttaccaacagatttcattggttcttgggttctcccgaagcctatccatggtttatagattaagaattgatgaggtagctgggcacagtggctcacacctacgatcacagcacttcgggaggctgaagcaagcagatcacttgaggtcaggagtttgagaccagcctggccaacatggtgaaaccctgtctctactaaaaatacaaaaagtagccagccgtgatgacaggcacctgtaatcccagctactcgggaggctgaggcatgagaattgcttgaacccgggaggcggaggttgcagtgagcctagatcatgccactgcactccaacctgggcagcagagcaagactctgtctcaaaaggggaaaaaaaaaattgctgatgtgacccatgaagggaactcattttcctcgtaattttggactgccacacattggtacctttagttctctgaaggcccacgtttttatcattaagacctatttgttagctagtagagctttatgttcgctgtccatgaaaccttctgtaaccacagtgactacaagtagttctttctctattgaattattaggtccagaatagaagatgtcattgtacactttatttccctcacactgtgttatgctctgatgtgctatgcttagctatctgtcagagattagtaaattataaaactcatgtgtactacttaagtttatatcttatgctagtttataagaacaattaaaaggacttagaagattaactttggt

SEQ ID NO: 22568 - DNA, 1565 bp, Homo sapiens
cccctccgggttaggcggctgtagcggagctcgaaaagagtggcgcagggtcgcgcggccccgcctccttccccgcccagcgaagctctctgaccacccctcttttctagagttctgcctcgcttcccggcgcggtcgcagccctcagcccacttaggataatggcgacagctgaggtactgaacattggtaaaaaattatatgagggtaaaacaaaagaagtctacgaattgttagacagtccaggaaaagtcctcctgcagtccaaggaccagattacagcaggaaatgcagctagaaaaaaccacctggaaggaaaagctgcaatctcaaataaaatcaccagttgtatttttcagttattacaggaagcaggtattaaaactgccttcaccagaaaatgtggggagacagctttcattgcaccgcagtgtgaaatgattccaattgaatgggtttgcagaagaatagcaactggttcttttctcaaaagaaatcctggtgtcaaggaaggatataagttttacccacctaaagtggagttgtttttcaaggatgatgccaataatgacccacagtggtctgaggaacagctgattgctgcaaaattttgctttgctggacttcttataggccagactgaagtggatatcatgagtcatgctacacaggctatatttgaaatactggagaaatcctggttgccccagaattgtacactggttgatatgaagattgaatttggtgttgatgtaaccaccaaagaaattgttcttgctgatgttattgacaatgattcctggagactctggccatcaggagatcgaagccaacagaaagacaaacagtcttatcgggacctcaaagaagtaactcctgaagggctccaaatggtaaagaaaaactttgagtgggttgcagagagagtagagttgcttttgaaatcagaaagtcagtgcagggttgtagtgttgatgggctctacttctgatcttggtcactgtgaaaaaatcaagaaggcctgtggaaattttggcattccatgtgaacttcgagtaacatctgcgcataaaggaccagatgaaactctgaggattaaagctgagtatgaaggggatggcattcctactgtatttgtggcagtggcaggcagaagtaatggtttgggaccagtgatgtctgggaacactgcatatccagttatcagctgtcctcccctcacaccagactggggagttcaggatgtgtggtcttctcttcgactacccagtggtcttggctgttcaaccgtactttctccagaaggatcagctcaatttgctgctcagatatttgggttaagcaaccatttggtatggagcaaactgcgagcaagcattttgaacacatggatttccttgaagcaggctgacaagaaaatcagagaatgtaatttataagaaagaatgccattgaattttttaggggaaaaactacaaatttctaatttagctgaaggaaaatcaagcaagatgaaaaggtaattttaaattagagaacacaaataaaatgtattagtgaataaa

SEQ ID NO: 22569 - DNA, 5368 bp, Homo sapiens
gcgcgacgattcgaggtgctctgtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcccctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcgtttgcccaccccccgtcagctgaggtggaagccattgctctggctaccctgcacgaccggatgacagagcagcacttcccccatcccatccagagtttctcccctgagagcatgccggaacccctcaatggccctatcaatatactgggtgagggccggcttgcgctggagaaggccaaccaggagcttggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatccaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccagggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctctttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcccctccccgccttttcaataaaggatgaatgaaggttgactgca

SEQ ID NO: 22570 - DNA, 4242 bp, Homo sapiens
aacaaacgcgcgcgacgattcgaggtgctctgtggccgcgagtgcatcttccacgaacctaattcatctctccagcaaaggacacatctctccagcaaaggacacctctctccagcaaaggacacctgcagagatgtccccagtccttcacttctatgttcgtccctctggccatgagggggcagcccctggacacactcggaggaaactgcaagggaaactgccagagctgcagggcgtcgagactgaactgtgctacaacgtgaactggacagctgaggccctccccagtgctgaggagacaaagaagctgatgtggctgtttggttgccccttactgctggatgatgttgctcgggagtcctggctccttcctggctccaatgacctgctgctggaggtcgggcccaggctgaacttctccaccccaacatccaccaacatcgtgtcagtgtgccgcgccactgggctggggcctgtggatcgtgtggagaccacccggcgctaccggctctcggtctggctttagactcttgggacctagacttctacaccaagcgcttccaggagctacagcggaacccgagcactgtggaggcctttgacttggcgcagtccaatagcgagcacagccgacactggttcttcaagggccagctccacgtggatgggcagaagctggtgcactcactgtttgagtccatcatgagcacccaggaatcctcgaaccccaacaacgtcctcaaattctgtgataacagcaggtgctgtgccctagactgggttggcgtcaggacccggggaggggaggccccaggccctggttgggttagtgtaggtcccagaaaggaagcaaggtccatgacgggtatgtccacagtgcaatccagggaaaggaagtccgattcctacggcctgaggaccccacacggccaagccgcttccagcaacagcaagggctgagacatgttgtcttcacagcagagactcacaactttcccacaggagtatgcccctttagtggtgcaaccactggcacagggggccggattcgagatgtccagtgcacaggccgcggggcccacgtggtggctggcactgccggctattgctttggaaatctgcatattccaggttacaatctgccctgggaggatccaagcttccagtatcctgggaattttgcccggcccctggaggttgccattgaagccagtaatggagcttctgactatggcaacaagtttggggaaccagtgctggctggcttcgcccgctccttgggcctccagctcccagacggccagcggcgtgagtggatcaagcccatcatgtttagtgggggcattgggtccatggaagctgaccacataagcaaggaggccccagagccaggcatggaagttgtaaaggttggaggtcccgtctacaggattggagttggaggtggagctgcttcatctgtgcaggtgcagggagataacaccagtgacctggactttggggctgtgcagcgaggagacccggagatggaacagaagatgaaccgtgtgatcagggcttgtgtggaggcccccaagggaaaccccatctgcagccttcatgatcagggcgctggtggcaatggcaatgtcctaaaagagctgagtgacccagctggagccatcatttacaccagccgcttccagcttggggacccaaccctgaatgccctggaaatctggggggctgagtaccaggaatcaaatgctcttctgctgaggtcccccaaccgggacttcctgactcatgtcagtgcccgtgaacgttgcccggcttgcttcgtgggcaccatcactggagaccggagaatagtgctggtggacgatcgggagtgtcctgtcagaagaaatggccagggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgt

SEQ ID NO: 22571 - DNA, 3470 bp, Homo sapiens
gtcaagggagagagacgaatagtgctggtggacgatcgggagtgtcctgtcagaagaaatggccagggggatgcccccccgacacccctgccaacccctgtggacctggagctcgaatgggtgctgggcaagatgcctcggaaggagttcttcctgcagaggaagccccccatgctgcagcctctggccttgcccccagggctgagcgtgcaccaggctctggagagggttctgaggctgcccgccgtggccagcaagcgctacctcaccaataaggtggaccgctctgtgggaggcctggtggcccagcagcagtgcgtggggcccctgcaaactcctctggcagatgtagcggttgtggcactgagccatgaggagctcataggggctgccacagccttgggagaacagccagtcaagagcctgctggacccaaaagtcgccgcccggctggccgtggccgaagccctcaccaacctggtgtttgctctggtcactgacctccgggatgtgaagtgtagcgggaactggatgtgggcagccaagctcccaggggagggcgcagctttggcggatgcctgtgaggctatggtggcagtgatggcagccctgggtgtggcagtggatggtggcaaggactccctcagcatggctgctcgggttggcactgagaccgtgcgggctcctgggtcactggtcatctcagcctatgccgtctgcccagacatcacagccactgtgaccccagacctcaagcatcctgaagggagaggccatctgctctatgtggctctgagccctgggcagcaccggctcgggggcacagctctggcccagtgcttctcccagcttggggaacaccctccagacctggaccttcctgagaacttggtgcgggccttcagcatcactcaggggctgctgaaagaccgcctcctctgctcaggccacgatgtcagtgacggaggcctcgtcacatgcctgctggagatggcctttgctggaaattgcgggctacaggtggatgtgcctgtccccagggttgatgtcctgtctgtgctgttcgctgaggagccaggcctcgtgctggaggtgcaggagccagacctggcccaggtgctgaagcgttaccgggatgctggcctccattgcctggagctgggccacacaggcgaggccgggccccacgccatggtccgggtgtcagtgaacggggctgtggttctggaggagcctgttggggagctgcgagccctctgggaggagacgagtttccagctggaccggctacaggcagagcctcgctgtgtggcagaggaggaacggggcctgagggagcggatggggcccagctattgcctgccccccacctttcccaaagcctccgtgccccgtgagcctggtggtcccagcccccgagtcgccatcttgcgagaggagggcagtaatggagaccgggagatggccgatgccttccacttagctgggtttgaggtatgggacgtgaccatgcaggacctctgctctggggcaattgggctggacactttccgtggcgtggccttcgtgggcggcttcagctatgcagatgtcctgggctctgccaaagggtgggcagctgctgtgacctttcatcccagggctggggctgagctgaggcgcttccggaagcggccagacaccttcagcctgggcgtgtgtaatggctgtcaactgctggctctgctcggctgggtgggaggcgaccccaatgaggatgctgcagagatgggccctgactcccagccagcccggccaggccttctgctacgccacaacctgtctgggcgctacgagtctcgctgggccagcgtgcgtgtggggcctgggccagccctgatgctgcgagggatggagggcgccgtgctgcccgtgtggagtgcgcacggggaaggttacgtagcattttcttctccggaactccaagctcagattgaggccaggggcttggctccactgcactgggctgatgatgacgggaaccccacagagcagtaccctctgaatcccaatgggtccccagggggcgtggctggcatctgctcctgtgatggccgccacctggctgtcatgcctcaccctgagcgggccgttaggccttggcagtgggcatggcgaccccctccatttgatactctgaccacctccccctggctccagctctttatcaatgcccgaaactggaccctggaagggagctgctgactggccacaggggctcacctgggccccatggcttttcacctaagtgggtcctgccccctcccccatgaccttcaggagcaccccatattatttccaaaaatatcttggacagacaaggaccaaaatgccaaaatctcagcggactcgataatctgcctgctgatgttccttctgtggctgtgtctattttcagttctgctctaacatggcatgccctttctcagcccaggaaacagcatgtggttcagagaaaagagcgacaaggaaaagttaggactcctgaggtccgaacaggggcttctgttgcccacttcacaacacccagtgatcaccggtgtgcaattgcctccttggctctgagggatgttttgcgctcccttttctcatcattggggttagcgggtgcagacaaattcagcaatagtatgcagatcagcccctcaccacctcattgttctcatctggaactgaaactttctggatttctcttgaagtgctacactgcactgaatgtaaggaattgttgcttgtggaagtttctcagcgtttctggctgtcttagggctggcctcagaacccagcattcctgttatttgcttctaaattagcagctctctttttttttttttttttgaggcagtctcactctgtcacccaggctggagtacaatggcgtgatctcggcccactgcaacctctgcctcctgggttcaagcaattttcctgcctcagcctcccgagtagctgggagtacaggcacacaccaccacacccagctaatttttgtatttttagtagagatagggtttcaccatgtctcccaggctggtctcaaactcctaacctcaagtgattcgcctgcctcggcctcccaaagtgctgggattacaggtgggagccactacagctggcccagcagctctgtttctgatagaggtggttggggctctcatccctagatcctaaccctttagtatgctggaattctactcttcacttactgcattgactgttgttgattagttattattgcaaagcactgtcaccggcctcagggagtttatgtgtaatagaattaaaaataatagctgtgtataacacttagctcaagccacgcatgtgtgaggcatttggtatgtatctgaattaattctcactaaaattcagcaaaggacttgatagcccctccccgccttttcaataaaggatgaatgaaggttgactgc

SEQ ID NO: 22572 - DNA, 2149 bp, Homo sapiens
ccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggtaaaactctaagcaagttagctgtagtgccatttcagaaactggcctaaatggctatgtagaacatttcattaaccctataagtcattcagtattcttttctctctgtgggagtgatacagtcttggtttgtattttgtttgaatcaaaactggttatagcaatactcaaatggaaaaaacttcatgatagcgtaagtttggaaagtttagcaaaatcacagtggtactgatttttatttgttttctattttttttattttatatttttaatttttttaacagggtcttcctctctcgcccaagttctcatgcctcagcctcccaaatagctgggactacaggcacaggccaccacacctggctaatttttttgtattttttgtggagatggggtttcaccatgttgccaaggccagtctgaaatcctgggctcaagtgatcctcctgctttggcctcccaaaatgctgggattataggcatgagccgctgcacttggcctgatactgatttttattccttgcgttatcacatagtgttgtatttgaaacatagttcatggttttatcaaagaactgaagatgagaatactggtcatctaactttgtaatttgatttgattatactgtaaagtttgacagtctcattttatcactgcgtttgtatctattactaaaatgtattttttgacctcttactgattcattgttggtatgtacaaactgttgacttgtaaaatcaataaagtcttagttggaaa

SEQ ID NO: 22573 - DNA, 3341 bp, Homo sapiens
tggtcccgcgccggtcccggtgggccgacttccggcgagcgggcaagcgggaaccaggtggccacccggtgtcggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 22574 - DNA, 3490 bp, Homo sapiens
ctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 22575 - DNA, 3469 bp, Homo sapiens
atgtccgccatgttagtgtctgacgcaggcgccattacaggagccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcaggtttctaatgatctattactaaaaattaaagatactgttcttcagaggacagtggatggcatgcagcaagagggtactccatatacaggtattctctatgctggaataatgctgaccaagaatggcccaaaagttctagagtttaattgccgttttggtgatccagagtgccaagtaatcctcccacttcttaaaagtgatctttatgaagtgattcagtccaccttagatggactgctctgcacatctctgcctgtttggctagaaaaccacaccgccctaactgttgtcatggcaagtaaaggttatcctggagactacaccaagggtgtagagataacagggtttcctgaggctcaagctctaggactggaggtgttccatgcaggcactgccctcaaaaatggcaaagtagtaactcatgggggtagagttcttgcagtcacagccatccgggaaaatctcatatcagcccttgaggaagccaagaaaggactagctgctataaagtttgagggagcaatttataggaaagacgtcggctttcgtgccatagctttcctccagcagcccaggagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttagaaagaattatttgctgtttgcatggtggttttttatcatggacttggcccaaaagaaaaactgctaaaagacaaaaaagacctcacccttacttcatctatttttttaataaatagagactcactaaaaacaagactagttagtgcagcatatctgagaca

SEQ ID NO: 22576 - DNA, 837 bp, Homo sapiens
cgcataagttgtcagtccccagcagtgtttgggagccttaacaggcttgctaagtgcctgagattaaaggcgaagaggaagaagagcaagaagggcaacccggtgtttaacacacggctttcaggcgctctcagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacaggggg

SEQ ID NO: 22577 - DNA, 1036 bp, Homo sapiens
cccgtccctggcggacaaccgggcctacgagtagctaaacggcaggggggacccaaacaggggagaagggtgaacatcttaactcggttctgaaacagggagtcttgggttacctcggaaaaggcgaagttcctcgagggaaaaggaagggagcggctgggggggcggttggggggggcccggaaaatggatcccaggcccaggcggggccctagcggggcctgagccggggaacgactgcgtctccgaagaaaggtgccaaagaaggctaggtttcattttcctttggaatttctgctttacagacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgagtgcagacttccctgctttggttgtgaaggccagtggtcttgcagctggaaaaggggtgattgttgcaaagagcaaagaagaggcctgcaaagctgtacaagagatcatgcaggagaaagcctttggggcagctggagaaacaattgtcattgaagaacttcttgacggagaagaggtgtcgtgtctgtgtttcactgatggcaagactgtggcccccatgcccccagcacaggaccataagcgattactggagggagatggtggccctaacacagggggaatgggagcctattgtccagcccctcag

SEQ ID NO: 22578 - DNA, 697 bp, Homo sapiens
agccgtctctcttgaggcgaccgtgtccgcataagttgtcagtccccagcagtgtttgggagccttaacaggcttgctaagtgcctgagattaaaggcgaagaggaagaagagcaagaagggcaacccggtgtttaacacacggctttcaggcgctctcaggtggcgccaagttcagtttcgacagggatatgcatccgggagagaatttttcagcccccgcccccactggcatgtgagaggaggaactcgctgttgccctgtgtcttccccaacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttcattttgag

SEQ ID NO: 22579 - DNA, 715 bp, Homo sapiens
ttttggcgctcccccccggcgctcctggaaacactgcgtggcaccccgtaccactgtcacattataaacgtgctaaggcttgggtgtctcggctggggagcagtcaggcagcgcccagggcgggagggaatcagactagattctcgccgcggagacccagggccgcgcggaccaatggggcagggaagccgtcgtagggcggggcagtgaggggcggtgccgcgctggtcccgcgccggtcccggtgggccgacttccggcgagcgggcaagcgggaaccaggtggccacccggtgtcgacagaacaatggcagcccgagtacttataattggcagtggaggaagggaacatacgctggcctggaaacttgcacagtctcatcatgtcaaacaagtgttggttgccccaggaaacgcaggcactgcctgctctgaaaagatttcaaataccgccatctcaatcagtgaccacactgcccttgctcaattctgcaaagagaagaaaattgaatttgtagttgttggaccagaagcacctctggctgctgggattgttgggaacctgaggtctgcaggagtgcaatgctttggcccaacagcagaagcggctcagttagagtccagcaaaaggtttgccaaagagtttatggacagacatggaatcccaaccgcacaatggaaggctttcaccaaacctgaagaagcctgcagcttc

SEQ ID NO: 22580 - DNA, 1820 bp, Homo sapiens
taaatgtactgctccgacttgtgggtcctatacagaaggaaatgatgcactgagagtttgacttacaaggaatctggagtagatatcgcagctggaaatatgctggtcaagaaaattcagcctttagcaaaagccacttccagatcaggctgtaaagttgatcttggaggttttgctggtctttttgatttaaaagcagctggtttcaaagatccccttctggcctctggaacagatggcgttggaactaaactaaagattgcccagctatgcaataaacatgataccattggtcaagatttggtagcaatgtgtgttaatgatattctggcacaaggagcagagcccctcttcttccttgattacttttcctgtggaaaacttgacctcagtgtaactgaagctgttgttgctggaattgctaaagcttgtggaaaagctggatgtgctctccttggaggtgaaacagcagaaatgcctgacatgtatccccctggagagtatgacctagctgggtttgccgttggtgccatggagcgagatcagaaactccctcacctggaaagaatcactgagggtgatgttgttgttggaatagcttcatctggtcttcatagcaatggatttagccttgtgaggaaaatcgtggcaaaatcttccctccagtactcctctccagcacctgatggttgtggtgaccagactttaggggacttacttctcacgcctaccagaatctacagccattcactgttacctgtcctacgttcaggacatgtcaaagcctttgcccatattactggtggaggattactagagaacatccccagagtcctccctgagaaacttggggtagatttagatgcccagacctggaggatccccagggtcttctcatggttgcagcaggaaggacacctctctgaggaagagatggccagaacatttaactgtggggttggcgctgtccttgtggtatcaaaggagcagacagagcagattctgagggatatccagcagcacaaggaagaagcctgggtgattggcagtgtggttgcacgagctgaaggttccccacgtgtgaaagtcaagaatctgattgaaagcatgcaaataaatgggtcagtgttgaagaatggctccctgacaaatcatttctcttttgaaaaaaaaaaggccagagtggctgtcttaatatctggaacaggatcgaacctgcaagcacttatagacagtactcgggaaccaaatagctctgcacaaattgatattgttatctccaacaaagccgcagtagctgggttagataaagcggaaagagctggtattcccactagagtaattaatcataaactgtataaaaatcgtgtagaatttgacagtgcaattgacctagtccttgaagagttctccatagacatagtctgtcttgcaggattcatgagaattctttctggcccctttgtccaaaagtggaatggaaaaatgctcaatatccacccatccttgctcccttcttttaagggttcaaatgcccatgagcaagccctggaaaccggagtcacagttactgggtgcactgtacactttgtagctgaagatgtggatgctggacagattattttgcaagaagctgttcccgtgaagaggggtgatactgtcgcaactctttctgaaagagtaaaattagcagaacataaaatatttcctgcagcccttcagctggtggccagtggaactgtacagcttggagaaaatggcaagatctgttgggttaaagaggaatgaagccttttaattcagaaatggggccagtttag

SEQ ID NO: 22581 - DNA, 2611 bp, Homo sapiens
actccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 22582 - DNA, 6121 bp, Homo sapiens
cacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttc

SEQ ID NO: 22583 - DNA, 4476 bp, Homo sapiens
gacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtccaatggtggtcatcccctgggtatagatttgatgtcaccgtcttttatgtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaag

SEQ ID NO: 22584 - DNA, 6020 bp, Homo sapiens
tccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgctcgctgtggtgatgaagttgctcgttatttagatcaccttttggcgcacactgctccccatcctaaactagcccctacctcacagaagggagggctagatcggttccaagctgctgtgcaaacaacctgcgacttaatgtccttggtgaccaaggccaaggaactgcatgtacagaatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttca

SEQ ID NO: 22585 - DNA, 6173 bp, Homo sapiens
tcgcgcccgccccgcctcccgctcgcgtctcccgcaaggtggaggcggcgcagcggtcgttgacctgttggcggcggccgggcgggaggctgtgggccgcggcggtctcccggggttgaggggaggatgcaggagtcacacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcaggtggaatttcgtagactgtcaatctcagctgagagtcagtccaatggtggtcatcccctgggtatagatttgatgtcaccgtcttttatgtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttca

SEQ ID NO: 22586 - DNA, 5944 bp, Homo sapiens
cacgcggaggccggactggactaagggggcaggagcggcgcctggggcgctgcggcggggctctagaccgcgggaagccagtgctagcgctggcgcgtggtgggcccctgaggccgccggagtccggagaggtacgcggaatccgcggcgccaggcctgagcggtgggagggctctgcggggcctggtgttcaggcgtcccaccacgagggtggagcagcgttggatacttgttccttagggaccgaaggctccggtggcacccgggctatttctcagaggacaattagtaacgtgtcgccatgaggagccggagtaactccggggtccggctggacggctacgctcgactggtgcaacagaccatcctgtgccatcagaatccagtgactggcttgcttccagccagctatgatcagaaagatgcttgggtccgagataatgtgtacagcatcttggctgtgtggggtttgggcctggcctatcggaagaatgcagaccgggatgaggataaggcaaaggcctatgaattggagcagagtgtagtgaagctgatgagaggactactgcactgcatgatcagacaggtggataaagtagaatccttcaaatatagtcagagtactaaggatagcctccatgcaaagtacaacaccaaaacctgtgccactgtagtgggtgatgatcaatggggacacctgcagttggatgctacctctgtgtacctgctcttcttagcccaaatgactgcctcaggactccatatcatccacagcctagatgaagtcaatttcatacagaaccttgtgttttacattgaagctgcatataaaactgctgacttcgggatatgggaacgtggagacaagaccaaccaagggatctcagagttgaatgccagttcagttggaatggcaaaggcagccctggaagcattagatgaactggatctgtttggtgtgaaaggtgggcctcaatcagttatccatgtcctggctgatgaagtacagcactgccagtctatcctaaattcactactgccccgtgcttcaacatcaaaagaggttgatgctagtctactctcagtggtttccttccctgcctttgcagtagaggatagccagttggtggagctcacaaaacaggaaatcatcaccaagcttcagggtcgttatggttgctgtcgctttctacgagatggatataaaactcctaaagaggatcccaatcgtctgtactatgaaccagctgagctgaagctatttgaaaacattgagtgtgaatggccattgttctggacatactttattcttgatggggtcttcagtggcaatgcagaacaggttcaagaatataaagaggctcttgaagcagtcctcatcaagggcaaaaatggagtcccacttctgccagagctgtacagtgttcctcctgacagggtcgatgaagaatatcagaatcctcacactgtggaccgagtccccatggggaaattgcctcacatgtggggtcagtctctatacattttaggaagcttgatggcagagggatttttagcccctggagaaattgatcccctgaatcgcaggttttctactgtaccgaagcccgatgttgtggttcaagtctccattctagctgaaacagaagaaatcaagaccattttgaaggacaagggaatttacgtggagaccattgctgaggtataccccatcagagtacaaccagctcgtattctcagccacatttattccagcctaggatgcaacaatagaatgaaactcagtggacgaccctacagacacatgggagtgcttggaacttcaaaactctatgacattcggaaaactatctttactttcactccacagtttatagaccagcaacagttctacctggctctggacaacaagatgatagtggaaatgcttagaacagacctctcctacctctgtagccgctggcggatgacaggccagcccaccatcaccttccccatctcacacagcatgcttgatgaagatggaacaagcttgaattcaagtatcctggcagcactccgaaaaatgcaagatgggtattttggtggggcaagggttcaaacaggtaaattgtcagagtttttgacaacatcttgttgcacacacttgagcttcatggaccctggacctgagggtaagctgtacagtgaagattatgatgacaactatgattacctggaatctggcaactggatgaatgattatgattcaaccagtcatgatgttcacatgtatcttcctacgaagttatttcaggcttcccggccttcattcaacttacttgattcacctcatccccgacaggagaaccaggttccctctgttcgtgtagaaatacatcttcctagagaccagtctggggaggtggactttaaagcactggttttacagttgaaggagacctcaagcttacaggaacaagctgatatcctctatatgctgtatactatgaaaggacctgactggaacactgaattgtataatgaacggagtgctacagtgagagagcttcttaccgagctgtatggcaaagtgggagaaattcgtcactggggcctgatccgatacatttctgggatcttaaggaagaaagtggaagcacttgatgaggcctgcacagaccttctctcccaccagaaacatttgacagtaggacttcctccagaacctcgagaaaagactatctctgcacctctgccctatgaggcgctcactcagctgatagatgaagccagtgaaggggatatgagcatttcaatccttacacaggaaataatggtatatctagccatgtatatgcgaacccagcctggcctctttgctgaaatgtttcgacttcgaattggtctgatcatacaagttatggcaacagaactggcccactcccttcgatgctcagctgaggaagccacagagggcctgatgaatctcagtccttcggccatgaagaatctcctgcatcacattctcagcggcaaggagtttggagtggaacgaagcgttcgtcccactgattcaaatgtcagtcctgctatttctatccacgagattggtgctgttggagcaaccaaaacagaacgaactgggatcatgcagttaaaaagtgagataaagcagtcacctggaacctctatgactccaagtagtgggtcctttcctagtgcatatgatcagcagtcatctaaagatagtcgtcaaggtcaatggcaacgccgaagaaggctggatggggcactgaatagagttccagttggattttatcagaaagtatggaaagttttgcagaagtgtcacggactttctgttgaagggtttgtccttccttcctctaccactagagagatgactccaggtgagattaaattctctgttcatgtggagtctgtcctgaatcgtgtacctcagccagagtaccgtcagctgctggttgaagccatccttgtcctcaccatgctggcagatattgaaattcatagcatcggaagcatcattgctgtggaaaaaatagtgcatattgccaatgacttgttccttcaagaacagaaaacccttggcgcagatgataccatgttggcaaaggatcccgcatctggcatctgtactcttctgtatgacagtgcacccagtggcaggtttggcaccatgacctacctctccaaggcagccgccacctacgtgcaggagttcctgccccacagcatctgtgccatgcaatgagggctttggttcctggcttctgggagccttttgacagctggtccctgcctcggttgattgtgcatggaactaaaatgttattgcctaatcactccaaccctgcccctttctgtcccatccttcccaagaagagagaactttttcgataaactaactactgtagaagaagtgaacacttacctggaggctcaccttgcagaaccagtgacaatcttatgagtataatgaacactcagccaggcctgtcatgattggctttatttctttcatcattcataaaagtttgcatgtgtttttattctctagatctgttaccaatatagttttctaactcctgtttggggagcaagtgttaataataacttattcctaaagcttggtttttcttttttgtgattttattgtgtatatgagtggtgggtactttgggacattatttcaaatgagtaaactctaaattgttaaatatttatgctgctataaattagaattacctattctacgtgccttttcttaggaaaagagagtactggatcatggttttcttccttacttacaggttgcttcacactgagtgataatttaaaattgtttctatgtagaatcattgtctctactgttgccctctctgtgtctgcacacataatgcctctctcactttggtgaaatatcaaaaaaatgcaagtacagcatgcatatttaagaatttctgaactaacacttgaaatcacattttataaagattgttggtactcagagttgtatttgcagcagaaaatgcagaataacccagaaatggagcccggagcccaattccagagaggaagggaaagaagagacgatgcctggacaatgtcttatacatagggaacagagagggaatcagaggtggcttagttccctgaagacagccttatgcgcttaatccctgcctttgaaaaatgggccaatacacaacacagacaataatttgaagcgtctgtattcagcaaagataaatacagcagtccagtctataggtgctctacttagcattcttttcatgtgctcctggtctctgtctcactcacctactttctactacatccaactcaactccctgacaccctatccccccatctattcttaaactctttcatatatattttcacttcctaattctagtgtacatatccctgtatatcatggtatctgtgggcatatgtctgtttcttataaagacacatatttgtgtgtgtatgtgtgtgtgtgtgtgtgtgtgtgtataagcatacatgggaatttttctgaatgtaagcagttttgatgtgtctgtatatcaatctgtatctacatttgatggactgagtaagaatgttgcatgtgagagaagggatgtgactgtggactcagattgacacacacagattggtggaagaatagcttcagtcctcttccttcatcccatatgtaggtagccttgcttgacaaatgtttcttctaactctccttcttctgaattgtgcagagactctgttaacttccctttttgcacttagataacttcctacttcaaccccctcctttatcttggatttctaaagtttttccccaatattgggaatggtgagggtggggatgagagactctctgaacaattcttgcagaaccagtgacaatcttatgaatataatgaataagtaagcatatagtagggtgatagaatacagatagtagaaacaaagagaggacagcaaaccttttcagcacttctctcagagcaaatggaaacacacagtaagtagctttctgactacattattttctggtcacttttaaagaaagtttacaacctgttctgaaactatttgtcttttcactggttgtaagtgtaccccaatctcagggagtatatctgtagtgccacaggcaaaagatccactccttcccacactcatttgcctgaacttactcgaagggctgcatttctctgagtttacgaaattgtgtcattatggtccccatacagtggtatttaacttttaaagcaacttttaagaaaactcgacttgttttttgttcattttaagtgtgtggtactaaaaagacatgttagactttttttaaaaaagcacttatgttttgaaaatagaataaataataagaatttccaattaaatcatgtctggtgccaatgtgcaaaacttc

SEQ ID NO: 22587 - DNA, 1431 bp, Homo sapiens
acgttagcctccggtcatcaaatagcaaaacccaaaacaacagcagatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgacctgatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggt

SEQ ID NO: 22588 - DNA, 1717 bp, Homo sapiens
gatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcatacagctgaaggacacttatgagaccaacactttcttcttcttggtgtttgacctatgggaagacactgatacaatggagatggaacagaaatggtgcttgggctgggactctcccaagtccaccaacttcagggcccagggcagggcaaggatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctcttta

SEQ ID NO: 22589 - DNA, 1566 bp, Homo sapiens
gatgatatcttccaagtgtctgctcgggacacggcttcagccctctgtggtcccctctccccggggggctttgggattcttgtcaagctccttcaagagcctgcaagcacttaaccagccacccagagttccctcactgaagatctgagcatgacccgggacgaggcactgccggactctcattctgcacaggacttctatgagaattatgagcccaaagagatcctgggcaggggcgttagcagtgtggtcaggcgatgcatccacaagcccacgagccaggagtacgccgtgaaggtcatcgacgtcaccggtggaggcagcttcagcccggaggaggtgcgggagctgcgagaagccacgctgaaggaggtggacatcctgcgcaaggtctcagggcaccccaacatcagatgaagagaggggagctctttgactacctcactgagaaggtcaccttgagtgagaaggaaaccagaaagatcatgcgagctctgctggaggtgatctgcaccttgcacaaactcaacatcgtgcaccgggacctgaagcccgagaacattctcttggatgacaacatgaacatcaagctcacagactttggcttttcctgccagctggagccgggagagaggctgcgagaggtctgcgggacccccagttacctggcccctgagattatcgagtgctccatgaatgaggaccacccgggctacgggaaagaggtggacatgtggagcactggcgtcatcatgtacacgctgctggccggctccccgcccttctggcaccggaagcagatgctgatgctgaggatgatcatgagcggcaactaccagtttggctcgcccgagtgggatgattactcggacaccgtgaaggacctggtctcccgattcctggtggtgcaaccccagaaccgctacacagcggaagaggccttggcacaccccttcttccagcagtacttggtggaggaagtgcggcacttcagcccccgggggaagttcaaggtgatcgctctgaccgtgctggcttcagtgcggatctactaccagtaccgccgggtgaagcctgtgacccgggagatcgtcatccgagacccctatgccctccggcctctgcgccggctcatcgacgcctacgctttccgaatctatggccactgggtgaagaaggggcagcagcagaaccgggcagcccttttcgagaacacacccaaggccgtgctcctctccctggccgaggaggactactgaggggctggccagtcagggagggctagggggcaggtggggaggggaagccatggaaatacaagtcaaaggggtgagatgcgtgcaggcctctgcagaaggagcacttggccctggccaggaacccctggaactgaggccacgatcccctctcaaaggctgtgcacaagggaagtgggtgttcccaccacacagcaatacctgcaggctggggcaggccctgggtgggcagagatcacacgtggcctgagaaccaggaaccccctgctcctctacttcctagatgagccaccatctccatttctcttta

SEQ ID NO: 22590 - DNA, 3198 bp, Homo sapiens
ccatcctggttcagccactgacagacagctccccaatccagcactctgcctgctccttcttgtatccaaccctccaaaaggcagggacaagggacagaagaccatgtgcaaggcctggaggaagtgggtcagcacaggcctgtgaacaagccaggccagtcttggcggcccaagtggagctcacctctccctcccctctcctctcctccccttgccctcaaaatagctccctgagctgccaggccaagaccctcccattgcaggggaggcggggcgtgctgcccagagccaggctttaaatccccttgaggctggggagctccactccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaggatctactacctgtctttagagttctatatgggacggacgctacagaacaccatggtgaacctggccttagagaatgcctgtgacgaggccacctaccagctgggcctggacatggaggagctggaggaaattgaggaggatgcggggctgggcaacgggggcctgggccggctggcagcctgctttcttgactccatggcaacactgggcctggccgcctatggctacgggattcgctatgagtttgggatttttaaccagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccggatgaggccatctgagcctccagaccagaccccaaaccagcccttgagtctgtcacactctcttgggccagccccagcacctcatgcagagggtggggtactggagttagatctctaagcccctcctggaaccctcattttccccactctcaatgtcccagtgtccagcgtgactaaggacacgggcccccttccgtcctcgggctcccggtcccctcctatttatggggtctgaccaactgcacccactccctaataaattcattctccttgggagcctcctta

SEQ ID NO: 22591 - DNA, 2594 bp, Homo sapiens
actccttggctggaggcagtgctgaggccgccgtcccctctaccatcagtccagtccggcccgccctcctgcagccatgtcccggcccctgtcagaccaagagaaaagaaagcaaatcagtgtgcgtggcctggccggcgtggagaacgtgactgagctgaaaaagaacttcaaccggcacctgcatttcacactcgtaaaggaccgcaatgtggccaccccacgagactactactttgctctggcccataccgtgcgcgaccacctcgtggggcgctggatccgcacgcagcagcactactatgagaaggaccccaagaggatctactacctgtctttagagttctatatgggacggacgctacagaacaccatggtgaacctggccttagagaatgcctgtgacgaggccacctaccaggtgggcctgggccggctggcagcctgctttcttgactccatggcaacactgggcctggccgcctatggctacgggattcgctatgagtttgggatttttaaccagaagatctccgggggctggcagatggaggaggccgatgactggcttcgctacggcaacccctgggagaaggcccggcccgagttcacgctacctgtgcacttctacggccatgtggagcacaccagccagggtgccaagtgggtggacacacaggtggtactggccatgccctacgatacgcccgtgcctggctatcgcaacaatgttgtcaacaccatgcgcctctggtctgccaaggctcccaatgacttcaacctcaaggacttcaatgtcggtggctacatccaggctgtgttggaccgaaacctggcggagaacatctctcgtgtcctgtaccccaatgataatttcttcgaagggaaggagctgcggctgaagcaggagtatttcgtggtggctgccaccctccaggacatcatccgtcgcttcaagtcttccaagttcggctgccgtgatcccgtgcgcacgaacttcgatgccttcccagataaggtggccatccagctcaatgacacccacccctccctggccatccccgagctgatgaggatcctggtggacctggaacggatggactgggacaaggcgtgggatgtgacagtgaggacctgtgcctacaccaaccacacggtgctgcccgaggccctggagcgctggccggtgcacctcttggagacgctgctgccgcggcacctccagatcatctacgagatcaaccagcgcttcctcaaccgggtggcggccgcattcccaggggacgtagaccggctgcggcgcatgtcgctggtggaggagggcgcagtgaagcgcatcaacatggcacacctgtgcatcgcggggtcgcacgccgtcaacggcgtggcgcgcatccactccgagatcctcaagaagaccatcttcaaagacttctatgagctggagcctcataagttccagaataagaccaacggcatcacccctcggcgctggctggttctgtgtaaccccgggctggcagaggtcattgctgagcgcatcggggaggacttcatctctgacctggaccagctgcgcaaactgctctcctttgtggatgatgaagctttcattcgggatgtggccaaagtgaagcaggaaaacaagttgaagtttgctgcctacctagagagggaatacaaagtccacatcaaccccaactcactcttcgacatccaggtgaagcggattcacgaatataaacgacagctcctcaactgcctccatgtcatcaccctgtacaaccgcatcaagagggagcccaataagttttttgtgcctcggactgtgatgattggagggaaggctgcacctgggtaccacatggccaagatgatcatcagactcgtcacagccatcggggatgtggtcaaccatgacccggcagtgggtgaccgcctccgtgtcatcttcctggagaactaccgagtctcactggccgagaaagtgatcccagctgcagacctctctgagcagatctccactgcgggcactgaagcctcaggcaccggcaacatgaagttcatgctcaacggggctctgaccattggcaccatggacggggccaatgtggagatggcagaagaggcgggagaggaaaacttcttcatctttggcatgcgggtggaggatgtggataagcttgaccaaagagggtacaatgcccaggagtactacgatcgcattcctgagcttcggcaggtcattgagcagctgagcagtggcttcttctcccccaaacagcccgacctgttcaaggacattgtcaatatgctcatgcaccatgaccggtttaaagtcttcgcagattatgaagactacattaaatgccaggagaaagtcagcgccttgtacaagaacccaagagagtggacgcggatggtgatccggaacatagccacctctggcaagttctccagtgaccgcaccattgcccagtatgcccgggagatctggggtgtggagccttcccgccagcgcctgccagccccagcacctcatgcagagggtggggtactggagttagatctctaagcccctcctggaaccctca

SEQ ID NO: 22592 - DNA, 4134 bp, Homo sapiens
cgcagtgccgggcgccagagcagcggcgccagagcagctgcaccatcccggcgttcgcgtgtgccgccgctttcctcctccatctcttttcctccgcctccgccggcgcgatggcgaagccgctgacggacagcgagaagcggaagcagatcagcgtgcgcggcctggcggggctaggcgacgtggccgaggtgcggaagagcttcaaccggcacttgcacttcacgctggtcaaggaccgcaatgtggccacgccccgcgactacttcttcgcgctggcgcacacggtgcgcgaccacctcgtgggccgctggatccgcacgcagcagcactactacgagcgcgaccccaagcgcatttattatctttccctggaattctacatgggtcgcacgctgcagaacacgatggtgaacctgggccttcagaatgcctgcgatgaagccatctatcagttggggttagacttggaggaactcgaggagatagaagaagatgctggccttgggaatggaggcctggggaggctggcagcgtgtttccttgactcaatggctaccttgggcctggcagcatacggctatggaatccgctatgaatttgggatttttaaccagaagattgtcaatggctggcaggtagaggaggccgatgactggctgcgctacggcaacccctgggagaaagcgcggcctgagtatatgcttcccgtgcacttctacggacgcgtggagcacacccccgacggcgtgaagtggctggacacacaggtggtgctggccatgccctacgacaccccagtgcccggctacaagaacaacaccgtcaacaccatgcggctgtggtccgccaaggctcccaacgacttcaagctgcaggacttcaacgtgggagactacatcgaggcggtcctggaccggaacttggctgagaacatctccagggtcctgtatccaaatgataacttctttgaggggaaggagctgcggctgaagcaggagtacttcgtggtggccgccacgctccaggacatcatccgccgcttcaagtcgtccaagttcggctgccgggaccctgtgagaacctgtttcgagacgttcccagacaaggtggccatccagctgaacgacacccaccccgccctctccatccctgagctcatgcggatcctggtggacgtggagaaggtggactgggacaaggcctgggaaatcacgaagaagacctgtgcatacaccaaccacactgtgctgcctgaggccttggagcgctggcccgtgtccatgtttgagaagctgctgccgcggcacctggagataatctatgccatcaaccagcggcacctggaccacgtggccgcgctgtttcccggcgatgtggaccgcctgcgcaggatgtctgtgatcgaggagggggactgcaagcggatcaacatggcccacctgtgtgtgattgggtcccatgctgtcaatggtgtggcgaggatccactcggagatcgtgaaacagtcggtctttaaggatttttatgaactggagccagagaagttccagaataagaccaatggcatcaccccccgccggtggctgctgctgtgcaacccggggctggccgataccatcgtggagaaaattggggaggagttcctgactgacctgagccagctgaagaagctgctgccgctggtcagtgacgaggtgttcatcagggacgtggccaaggtcaaacaggagaacaagctcaagttctcggccttcctggagaaggagtacaaggtgaagatcaacccctcctccatgttcgatgtgcatgtgaagaggatccacgagtacaagcggcagctgctcaactgcctgcacgtcgtcaccctgtacaatcgaatcaagagagacccggccaaggcttttgtgcccaggactgttatgattgggggcaaggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctggggtgtggagccctccgacctgcagatcccgccccccaacatcccccgggactaggcacaccctgccttggcgggaccagcgggcatttgttttcttgctgactttgcacctccttttttccccaaacactttgccagccactggtggtccctgcttttctgagtaccatgtttccaggaggggccatgggggtcagggtggttttgagagagcagggtaaggaaggaatgtgctagaagtgctcctagtttcttgtaaaggaagccagagttgacagtacaaagggtcgtggccagccctgcagcttcagcacctgccccacccagagtgggagtcaggtggagccacctgctgggctcccccagaactttgcacacatcttgctatgtattagccgatgtctttagtgttgagcctctggattctggggtctgggccagtggccatagtgaagcctgggaatgagtgttactgcagcatctgggctgccagccacagggaagggccaagccccatgtagccccagtcatcctgcccagccctgcctcctggccatgccgggaggggtcggatcctctaggcatcgccttcacagccccctgccccctgccctctgtcctggctctgcacctggtatatgggtcatggacccagatggggctttccctttgtagccatccaatgggcattgtgtgggtgcttggaacccgggatgactgagggggacactggagtgggtgcttgtgtctgctgtctcagaggccttggtcaggatgaagttggctgacacagcttagcttggttttgcttattcaaaagagaaaataactacacatggaaatgaaactagctgaagccttttcttgttttagcaactgaaaattgtacttggtcacttttgtgcttgaggaggcccattttctgcctggcagggggcaggtctgtgccctcccgctgactcctgctgtgtcctgaggtgcatttcctgttgtacacacaagggccaggctccattctccctccctttccaccagtgccacagcctcgtctggaaaaaggaccaggggtcccggaggaacccatttgtgctctgcttggacagcaggcctggcactgggaggtgggggtgagcccctcacagccttgcccctccccaaggctggcaacctgcctcccattgcccaagagagagggcagggaacaggctactgtccttccctgtggaattgccgagaaatctagcaccttgcatgctggatctgggctgcggggaggctctttttctccctggcctccagtgcccaccaggaggatctgcgcacggtgcacagcccaccagagcactacagccttttattgagtggggcaagtgctgggctgtggtcgtgccctgacagcatcttccccaggcagcggctctgtggaggaggccatactcccctagttggccactggggccaccaccctgaccaccactgtgcccctcattgttactgccttgtgagataaaaactgattaaacctttgtggctgtggttggctgaca

SEQ ID NO: 22593 - DNA, 734 bp, Homo sapiens
tgaaacatcaccacacagtaccaccatccgtcacacctaaagcattggacaggagtcctccgtgtcctgaaatgttcactcgggcagcgcccggttaccacatggccaagctgatcatcaagttggtcacctccatcggcgacgtcgtcaatcatgacccagttgtgggtgacaggttgaaagtgatcttcctggagaactaccgtgtgtccttggctgagaaagtgatcccggccgctgatctgtcgcagcagatctccactgcaggcaccgaggcctcaggcacaggcaacatgaagttcatgctcaacggggccctcaccatcggcaccatggacggcgccaacgtggagatggccgaggaggccggggccgagaacctcttcatcttcggcctgcgggtggaggatgtcgaggccttggaccggaaagggtacaatgccagggagtactacgaccacctgcccgagctgaagcaggccgtggaccagatcagcagtggctttttttctcccaaggagccagactgcttcaaggacatcgtgaacatgctgatgcaccatgacaggttcaaggtgtttgcagactatgaagcctacatgcagtgccaggcacaggtggaccagctgtaccggaaccccaaggagtggaccaagaaggtcatcaggaacatcgcctgctcgggcaagttctccagtgaccggaccatcacggagtatgcacgggagatctgg

SEQ ID NO: 22594 - DNA, 1411 bp, Homo sapiens
ggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtgtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggta

SEQ ID NO: 22595 - DNA, 2188 bp, Homo sapiens
ggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatgcctcctacgtgtattattgcgcaaatgagacggtgcatggtgtggagtttgactttatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctggagtcatgggaacacacagcacagagggtaggggggccctctaggtgctgaatctacacatctgtggggtctcctgggttcagcggctgttgattcaaggtcaacattgaccattggaggagtggtttaagagtgccaggcgaagggcaaactgtagatcgatctttatgctgttattacaggagaagtgacatactttatatatgtttatattagcaaggtctgtttttaataccatatactttatatttctatacatttatatttctaataatacagttatcactgatatatgtagacacttttagaatttattaaatccttgaccttgtgcattatagcattccattagcaagagttgtaccccctccccagtcttcgccttcctctttttaagctgttttatgaaaaagacctagaagttcttgattcatttttaccattctttccataggtagaagagaaagttgattggttggttgtttttcaattatgccattaaactaaacatttctgttaaattaccctatcctttgttctctactgttttctttgtaatgtatgactacgagagtgatactttgctgaaaagtctttcccctattgtttatctattgtcagtattttatgttgaatatgtaaagaacattaaagtcctaaaacatctaa

SEQ ID NO: 22596 - DNA, 1476 bp, Homo sapiens
agactctcaccgcagcggccaggaacgccagccgttcacgcgttcggtcctccttggctgactcaccgccctggccgccgcaccatggacgcccccaggcaggtggtcaactttgggcctggtcccgccaagctgccgcactcagtgttgttagagatacaaaaggaattattagactacaaaggagttggcattagtgttcttgaaatgagtcacaggtcatcagattttgccaagattattaacaatacagagaatcttgtgcgggaattgctagctgttccagacaactataaggtgatttttctgcaaggaggtgggtgcggccagttcagtgctgtccccttaaacctcattggcttgaaagcaggaaggtgtgctgactatgtggtgacaggagcttggtcagctaaggccgcagaagaagccaagaagtttgggactataaatatcgttcaccctaaacttgggagttatacaaaaattccagatccaagcacctggaacctcaacccagatacccgatgtcaagggagcagtactggtttgtgacatgtcctcaaacttcctgtccaagccagtggatgtttccaagtttggtgtgatttttgctggtgcccagaagaatgttggctctgctggggtcaccgtggtgattgtccgtgatgacctgctggggtttgccctccgagagtgcccctcggtcctggaatacaaggtgcaggctggaaacagctccttgtacaacacgcctccatgtttcagcatctacgtcatgggcttggttctggagtggattaaaaacaatggaggtgccgcggccatggagaagcttagctccatcaaatctcaaacaatttatgagattattgataattctcaaggattctacgtttgtccagtggagccccaaaatagaagcaagatgaatattccattccgcattggcaatgccaaaggagatgatgctttagaaaaaagatttcttgataaagctcttgaactcaatatgttgtccttgaaagggcataggtctgtgggaggcatccgggcctctctgtataatgctgtcacaattgaagacgttcagaagctggccgccttcatgaaaaaatttttggagatgcatcagctatgaacacatcctaaccaggatatactctgttcttgaacaacatacaaagtttaaagtaacttggggatggctacaaaaagttaacacagtatttttctcaaatgaacatgtttattgcagattcttcttttttgaaagaacaacagcaaaacatccacaactctgtaaagctggtgggacctaatgtcaccttaattctgacttgaactggaagcattttaagaaatcttgttgcttttctaacaaattcccgcgtattttgcctttgctgctactttttctagttagatttcaaacttgcctgtggacttaataatgcaagttgcgattaattatttctg

SEQ ID NO: 22597 - DNA, 3584 bp, Homo sapiens
tttagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttc

SEQ ID NO: 22598 - DNA, 3709 bp, Homo sapiens
ggagggcacaggggagactaaaaaggccagggaagttggcctgccggaagttcccagggagaaggcagcgcgttgtacccgagatttgttttttaagattagaagaagactcagggagagacacattcttaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttc

SEQ ID NO: 22599 - DNA, 3777 bp, Homo sapiens
aaaaaggccagggaagttggcctgccggaagttcccagggagaaggcagcgcgttgtacccgagattcagggtctggctctgcttcccaggctagagtgcatttggcgcgatcacagctcactgcagcctcgacctcctgagctcaagcgaacttcctgcctcagcctcctgagcttcctgagtagctgcgactacagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatctaatatatatatgtgtgtgtgagtatatgtgtgcatgtttagcagatatttgtataaaatataaacactctgttgtcatataggctatatgcgaaattgttaattttaaaataacctcaggccacagacttgtagtaatcatttgaaggcctcacctagtgtccccttggtgacgtatgcagcagctcaaattaaacctttgtgcattgggttatgaataatcttttcttccaaagatggcaaaagcctcggtttgatttgatactaaagaataaatttctctgactttc

SEQ ID NO: 22600 - DNA, 3225 bp, Homo sapiens
acaggggagactaaaaaggccagggaagttggcctgccggaagttcccagggagaaggcagcgcgttgtacccgagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggatagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatct

SEQ ID NO: 22601 - DNA, 3366 bp, Homo sapiens
acaggggagactaaaaaggccagggaagttggcctgccggaagttcccagggagaaggcagcgcgttgtacccgagaaaaaagaaatcctctttttagaacatctcttggtggtaccatcagaaatgtcttccttaagtggaaaagtccaaaccgttttgggccttgtagagccaagcaaactgggccgtaccctgacccatgaacacctggccatgacctttgactgctgttactgtccacctcccccgtgccaggaagctatttccaaagaacctatcgtgatgaaaaatttatattggattcagaaaaacgcctattcccataaagaaaaccttcaattaaatcaggagacagaagccataaaggaagaactgttgtattttaaagctaatggtggaggggctttggtggaaaacacaaccactgggattagccgagacacacagacgttgaagaggcttgcagaagagactggcgtccatatcatatctggagccgggttttatgtggatgcaactcactcctcagagaccagggccatgtcagtggagcagcttaccgatgtccttatgaatgaaattctccatggagctgatggaaccagtatcaagtgtggcattattggagaaattggttgctcctggcctttgactgagagtgaaagaaaggttctccaggccacagctcatgcccaggctcagcttggttgtcctgttattatccatcctggacggagctccagggcaccatttcagattatccgaatattgcaagaagcaggcgcagacatctccaaaacagtcatgtcacacctggataggactattcttgataagaaagagctcttggagtttgctcaacttggctgctacttggaatatgatctctttggtactgaactacttcattaccaactcggcccagatattgacatgcctgatgataacaaaagaattagaagggtgcgtctcctggtggaagagggctgtgaagatcgaattctggtagcacatgacatacatacgaaaacccggctgatgaaatatggaggtcacggctattctcatatactcaccaatgttgttcctaaaatgttgctgagaggcataactgagaatgtgcttgataagattctaatagagaaccctaagcaatggctaactttcaaataggatggttgcttatgaattcacaccttgagtataaaacttgcagagaacattcagcgatttccagtccactgtgagatattaatcagttacctaggactaatgacagatcatttccttctgatgagaactaggagggtttgccttctctgagaccagctattacaactgtgcctctagggagttactcagcctaattgagccctattattttaacttaacaaaataaatacagaagtacctatttctaaacaatgatttaaagtctatatcccctaagcggagttgttgtttttctccctaatctatcagctgcactacttgagaaaatttaaagtgtttctagttaaattatttccttcttgagcgatctaatgtttcttgtaatattgatgatcctactaattatcctgctgttctttaattaatgcttaatgaataatatggcactgtaaaatagcttctgcaacaagggaagttaaattttgagacttttttccccaaaggatactgactgtaatacaattaccaattcacaatgataaaaatattttgaaaggttaattttatactgtccacctatctatatattcttctactgaaatgattttgatatctttggctttccggtatctatttttgccatacattttgctgttttgcaaagtttgtataagaacacataacactactgaattataaaaattcaatcataaaagtcaaaatatattacataatatagtttaatgaatcattacatttataataacaaaggccacaatttaattaattggtaagatataatgcaaaaaaaaaaagagaaatgtttgccttatgtatattccctttatttcctttaccttttgtttttccttggacctaaacagagaaaataatgcttatgtatctgaagaaaaggtcagatctattggaaatgacagcccgatacttgagcctcctctttaaaaggtatccagccctgatattttgtgtaaataaaatgtttttaaaacctgttagttaaaacacttaggtgatgggcactgctgcttataaattcatcttttggttgaatcctcactatgctatttggtacctaaaaatattctccaaacccttgctgccagttcctctttgataaatatatagttaattcgaaataaaatccattgcaattcatttatgagttatcttacatatcacaaagaccaattagaattagtcattattcttgatgaagagtctgtttttaatcataaaaatcatgacagttactcagacccaggcatttcaacagagctaacaccaccttcagataggcacaccatgcataactcttgggaagttgagctttgctaaataaaagatatttctgctgatcaaagatgatcaagctttctgtgtattggaacagaaagtaacaaagaggaatgagccaggagaacaaactaattcctttaaataaataaaaaaaaaaaatgcaaatgtccttcaccagtaaagcaagcaaatttttaaaatctctgtttttgaaatctactcgtcaaagagttttcagaggcaatgaaaggggaacagatttttcattgtaatagtggaagttgtgtgatagttaggagatatcaacatgcatttttaatcttttccttagatgaaagagatggcttttggcagtgtgttctaaccagaaagaaaggatttgtattactctccaaatctactgtactgtcagcttcactccacctgagaaaaaagaaaaaaaaattgatagctcaaatgcatgtaattcataaacactgcaaaggagagccacttggtgtctgcagtcctcatattaacagtctgtcacagaatgcagttaaagtattgattggcatatggtaatagagcaaccatagccttaacttacagacctgtgaaataaagggcattttgacctaatacaattaattttctggataactcttaaagagaagtcattttaactgtttttgctactccatatattgtcattcaaaatatattttaacccaaaataagttaaataatttgtgcatgtttgtgtgtgtatatatgcatacacttttttatattaaaattttgaggctatacagccactgtgccctgtggaataaagccatatatataaatgttttatatgtatatgttttatacataaataaaacatttcatct

SEQ ID NO: 22602 - DNA, 839 bp, Homo sapiens
atgaaaagccttgtacaagaggcttcgtgccatgttcagcctgccccttagccttccactgtgtgaggacacagcattccttccttccaagtgctgcagctctcacaagacaatcaaacaagcccgcaccttgatcatgatcttcctagcctccggaacgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaata

SEQ ID NO: 22603 - DNA, 2745 bp, Homo sapiens
aggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggagagatttgcagacacagaagcggcacagagaaggccattgtgaagatcaaggcagaaaccggagttatggcatcataagccaaggaatgccaaggattgctggcaaccacctgatgttagaagagtcgaggacatgttcttctccagagcttttggatggtgtgtggccctgccaacctttacattttggacttccagcctccgaaatgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaagctgaggagtttcat

SEQ ID NO: 22604 - DNA, 2533 bp, Homo sapiens
agtcctctcgcagctgcgccaggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcagcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcatt

SEQ ID NO: 22605 - DNA, 2387 bp, Homo sapiens
tctcgcagctgcgccaggacagccggcgcgcggccgtgcccacaagttgccggcagctgagcgccgcgcctcctcctgctcgcagccccctacgcccacccggcggcggtggccagcgccaggacgcacatcccgcggacaccgaccccagatgtaaagcgggaccccagcccctcgccccccggcgcgatcgacagtctcgccagcgtctcctctgccaaaacccagggctggaagatgtggcagccggccacggagcgcctgcaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcacctatgggatctctagtggggtgggcagggtgctgatggggacgctggccgcagggaggaaggaacatctcgggagggccctctgttcctctcccacggcagatgccctcctctgtatgcaaatcagcacagcctttattgagctttacaactaacaacctgatagttggcagttaattcacagttacagataatgcttttatttacataaatataccaagtagtaccctcttattgtattcacttcatctattttcttagaatacttgcaattactaatgaccccttccctttccctcctgctgccctgtccaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagataaacttggcttgtctagagacccatgtcatcttaacctaaagggaaatcttattgcgttatcataaaattgatgatatcttagggtcagaattgccctttttttttattttgaatgggaagttctcactaaaacaatcctgagatttcttaatttcatggttctttaaatattataaacacagagtcaacatagaatgaaattgtatttgttaaaatacacacattggaggacaagagcagatgactacttttcgaagtaatgctgctccttcctaaaagtctgttttcaatcctggtaatattaggggcactgcggcacctaagaagccttaaatgagagctaatccaatctagagagcgatggtgtcagcatttcggtctgcatatctgtgtgtccgtatctgcgtttgtgtgcgtgtacgtgtgcccctgtgtgtgggcccagttttcaggcatgtagaataagcatggagtcatattgaggaggactcacttcttgaagatatgcttgttgctttacaacatatgtaagctattctttagcataaatgcattcattctttaataaaaatatgtttgcattaataaa

SEQ ID NO: 22606 - DNA, 1524 bp, Homo sapiens
atgaaaagccttgtacaagaggcttcgtgccatgttcagcctgccccttagccttccactgtgtgaggacacagcattccttccttccaagtgctgcagctctcacaagacaatcaaacaagcccgcaccttgatcatgatcttcctagcctccggaacgcactttcagaccatgctgaagtctaaattgaatgtcttaacactgaaaaaggaacctctcccagcggtcatcttccatgagccggaggccattgagctgtgcacgaccacaccgctgatgaagacaaggactcacagtggctgcaaggttacctacctgggcaaagtctccaccactggcatgcagtttttgtcaggctgcacagaaaagccagtcattgagctctggaagaagcacacgctagcccgagaggatgtctttccggccaatgccctcctggaaatccggccattccaagtttggctccatcatctcgaccacaaaggggaggccacagtgcacatggataccttccaggtggcccgcatcgcctactgcaccgccgaccacaacgtgagccccaacatcttcgcctgggtctacagggagatcaatgatgacctgtcctaccagatggactgccacgccgtggagtgcgagagcaagctcgaggccaagaaactggcccacgccatgatggaggccttcaggaagactttccacagtatgaagagcgacgggcggatccacagcaacagctcctccgaagaggtttcccaggaattggaatccgatgatggctgaatgaacttgagacgcttcagcaaaggcagcattggtcacggagttcaagggaatagatgagtaagcaacgtttcaaatttgggatgaaaagactgccaaactattggctgaccaaggtttttaaattcagaagagcaattctaaatctaaagaaatgtatcattaaagtaattacgttacattgaaacctgctgctgctgtgactgtgaggagggtgggagtgtggatggggaggaaggttctaggctctcttatttttctcatttcccaatgcctctctgtgggagagctccatgccagttttcaccacgctcaggcaaatactctgcagctgttattggatgggccattccgatctgccttatgaaattccacaagaatgttaggggcaccctctttccccttctaacatccttagagggatgaaatctcagcatatgttgcaggacaccaaaaggaagaaaacaatcaagcaaataaaataaacagtcaaacaaaccaggagtttaaaacaacaaccccaacaacagaagccttggcaaagaggaataagtgatcagcaagtgaacacactctatgtcaactctccttttatccagctgagatttatggtaacttatttaattaatggtcctgtctgatgcatccttgatggcaagcttcaaatctgatttggtatcaccgaggaaaccttgcccccatcactcagcattgcacttagatacagaatgagttagata

SEQ ID NO: 22607 - DNA, 1577 bp, Homo sapiens
gcccgctgggctaaatggggcagaggccgggaggggtgggggttccccgcgccgcagccatggagcagcttcgcgccgccgcccgtctgcagattgttctgggccacctcggccgcccctcggccggggctgtcgtagctcatcccacttcagggactatttcctctgccagtttccatcctcaacaattccagtatactctggataataacgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcgg

SEQ ID NO: 22608 - DNA, 1732 bp, Homo sapiens
cggccgccctggggtcggggcaattgccgcgttgccctgccctccgggatccctgggggcctctgctcctctctttgtggagacgtcgtttcaccggcggcgcgtgaccccggcagctgtccagagacccagagatgtccaatcacaggcgcacggtgcacaggcgcgcagggctgcctggaaccggcccaggcaggcagtgaccgggacctctccggaggggagaggacggtgccctcccgggcaggagctggccaggcaggcgctgcccagggcggcctccctgctggactacggcattgccactgagttatataaagacactatttggggaaggacagcgggtatactctggataataacgttctaaccctggaacagagaaaattttatgaagaaaatgggtttctagtaatcaaaaatcttgtacctgatgccgatattcaacgctttcggaatgagtttgaaaaaatctgcagaaaggaggtgaaaccattaggattaacagtaatgagagatgtgaccatttcgaaatccgaatatgctccaagtgagaagatgatcacgaaggtccaggatttccaggaagataaggagctcttcagatactgcactctccccgagattctgaaatatgtggagtgcttcactggacctaatattatggccatgcacacaatgttgataaacaaacctccagattctggcaagaagacgtcccgtcaccccctgcaccaggacctgcactatttccccttcaggcccagcgatctcatcgtttgcgcctggacggcgatggagcacatcagccggaacaacggctgtctggttgtgctcccaggcacacacaagggctccctgaagccccacgattaccccaagtgggaggggggagttaacaaaatgttccacgggatccaggactacgaggaaaacaaggcccgggtgcacctggtgatggagaagggcgacactgttttcttccatcctttgctcatccacggatctggtcagaataaaacccagggattccggaaggcaatttcctgccatttcgccagtgccgattgccactacattgacgtgaagggcaccagtcaagaaaacatcgagaaggaagttgtaggaatagcacataaattctttggagctgaaaatagcgtgaacttgaaggatatttggatgtttcgagctcgacttgtgaaaggagaaagaaccaatctttgaaatagccatctgctataactctttcaacagaaaaccaaaaccaaacgaaatgtctaaggaaaatgttttcttaatgagatgatgtaaccttttctatcacttgttaaaagcagaaaacatgtatcaggtacttaattgcatagagttagttttgcagcacaatggtgttgctttaatggaaaaaaaaaacagtaaaagtgaaatattactgttttaaggaaaactaatttagggtggcagccaataaaggtggttggtgtctaatttaagtgttaaatcaatttctttcattcagttagctctttacccaagaagaagtgaatgatttggagcttagggtatgttttgtatcccctttctgataaacccattccctaccaattttatgtcataagagatttttttcccccaaatctagaacaatgtataatacattcacatctagtcaagggcataggaacggtgtcatggagtccaaataaagtggatattcctgctcggacaa

SEQ ID NO: 22609 - DNA, 16216 bp, Homo sapiens
gcggtgcgcggtgggaggggcggacggcgcccggctggcaccgctcagatctgcttctccccggctcggggcgccgaggcggcgtccgggaggtgtcttctgcaaaggttgcctggcgctgtccaacatggaggaggcaccggcagcgggcgttacctgcgagcgggactaacccctgcctggcgttccgggcggcagtgcctggtccagagtccagggactcggctgcctgcacgccccgaggcggaccccggctctgactgctcccctggccgcgggcttctcgactgggacgcggcgcgaggagggagcgcggcggccccgagtctccctgagccatgggcaacgaggcgagcttggaaggggaagggctccccgaagggctggcggcggccgcagcggctggaggaggagctagcggggcggggagcccctctcacaccgcgatcccggccggcatggaggcggatttgagccagctgagcgaagaggagaggagacagatcgccgctgtcatgtcaagggcgcaggggctgcccaagggaagcgtccccccggccgctgcggagtcgccttccatgcacaggaaacaagagttggatagtagtcatcctccaaagcaatcaggaagacccccggaccctgggcgtccagctcaacctggtctcagtaaaagtagaactacagacactttcaggtcagagcagaaattgcctgggaggagtccttccactattagcttgaaagaatcaaagtccagaactgatttaaaggaagagcacaagtctagtatgatgcctggcttcctctcagaggttaacgctttaagtgctgtttcctctgttgtaaataaattcaacccttttgatttgatatcagactctgaggcatcccaggaagaaaccaccaagaaacaaaaagtggttcagaaggagcaaggaaaacctgaaggaatcataaaacctcctttacaacaacagccacccaagccgattcctaagcagcaaggacctggtagggatccgcttcagcaggatggcactcccaaatcaatatcttctcaacaaccagaaaaaattaaatcacaacctccaggtacaggaaagccaattcagggtcctacccagactcctcagacagaccatgcaaaattgccacttcaacgagatgcatccaggcctcagactaaacaggcagacatagtaaggggagaatcagttaaaccctcactgccaagcccatccaaaccacctattcagcaaccaactcctggaaaacctccagcacagcagcctggacatgaaaaatcacagcctgggcctgcaaagcccccagctcagccctcagggctaacaaagccattggctcaacaaccagggacagtgaaacccccagtccagccaccagggacaacaaagcctccagctcagcctcttggtcctgctaagcctccagctcagcagactgggtcagagaagccttcatcggagcagcctgggccaaaggctttagctcagcctcctggagttggaaagactccagctcaacagccagggccagcaaagcctccaacccagcaggtggggacaccaaaacccctagctcaacaacctgggctacagtctccagctaaggcacctgggcctacaaagactccagttcagcagcctgggccaggaaagattccagctcaacaggcaggacccggaaagacttctgcccagcagactggcccaacaaagcctccttcacaactgcctggcccagcaaagcccccacctcaacagcctggcccagcaaagcccccacctcaacagcctggctcagcaaagcccccatctcaacagcctggctcaacaaaacccccacctcaacagcctggcccagcaaagccctcacctcaacagcctggctcaacaaaacccccatctcaacagcctggctcagcaaaaccctcagctcaacagcctagcccagcaaagccctcggctcagcaatctacaaaaccagtaagccaaacaggatctggaaaacctctgcagccaccaacagtgtctccatctgcaaaacagcctccttcacaaggcctccctaaaaccatctgtcctctttgcaataccactgaacttctgttgcatgttccagaaaaggccaattttaacacatgcactgagtgtcaaaccactgtctgtagtctctgtggttttaatcccaatcctcatttaacggaggtaaaagagtggctctgtttgaactgtcaaatgaaaagagctctaggcggggatctggctccagttccgtcatcaccccagcccaaactgaagactgcacctgttaccactacatcagcagtgagcaaatcatccccacagccacagcagacttccccaaagaaggatgctgcaccaaaacaggatctctccaaggcacctgagcctaaaaagccaccaccactagtgaaacaaccaacccttcatggctctccttcagccaaggccaagcagccccctgaggcagattctttgtccaagccagcccctcccaaagaaccttctgtcccatctgagcaggacaaggcccctgttgctgatgataaaccaaagcagcccaagatggtaaagccaaccactgaccttgtatcttcatcatcagcaacaacaaaacctgatattccaagctccaaagtacagtcacaagctgaagagaaaacaacccctcctctaaaaacagactctgccaaaccctcacagagttttccaccaacaggggaaaaagtcagcccatttgattctaaagccatacctcgacctgcatcagattcaaaaattatttcacatcctggtcccagttcagagagcaaaggtcaaaaacaagttgaccccgtacaaaagaaggaagaacccaagaaagcacaaaccaaaatgagtcctaaaccagatgccaagccaatgccaaaagggtcaccaacaccccctggcccacgacctaccgctggccaaactgtccccacacctcaacagtccccaaagcctcaggagcagtcaaggcgtttcagtctgaatctgggaagtattactgatgcccccaaatcacagcctacaactcctcaagagaccgtgactgggaaactctttgggtttggagcatcaatcttcagccaggcatcaaatttaatttccactgcaggccaacctggacctcattcacaaagtggaccaggggccccaatgaaacaagcccctgccccttcacagccacctacttcacaagggccacccaaatccacaggtcaagcaccaccagcacctgcaaaaagtatacctgtgaaaaaggaaacaaaagccccagcagctgaaaaattagagcccaaagctgaacaagctccaacagtaaaaagaacagaaacagaaaaaaagccaccacctattaaggatagcaaatctttaacagctgagcctcaaaaggctgtccttcccacaaaactggagaaatcgcccaaaccagaatcaacctgtcctctctgcaaaactgaactcaacataggttctaaggatcctcctaacttcaatacttgcactgaatgcaagaatcaagtgtgtaatctctgtggatttaaccctacaccacatttgactgagattcaagaatggctttgtttaaattgccaaacccagagagcaatatcaggacagcttggagacatacgcaaaatgccacctgcaccatcaggacccaaagcatctcctatgcctgttcctacagaatcatcatctcagaaaacagcagtgcctccccaagtaaaattagtgaaaaagcaagaacaagaagtaaaaacggaagctgaaaaagtcattctggaaaaagtaaaggaaacactatcaatggaaaaaattcctcctatggtaaccacagatcaaaaacaagaagagagtaaactagagaaagacaaagcttcagctcttcaagaaaaaaagccactccctgaagaaaaaaaactaatccctgaagaagaaaagatacgttctgaagaaaaaaagccactcctagaagaaaaaaagccaacccctgaagacaaaaagctactcccagaggcaaaaacatcagccccagaagaacagaaacatgacttacttaaatctcaagtacaaattgctgaagaaaagcttgaaggcagagtggctccaaagacagtgcaagaagggaaacaaccacagaccaagatggaaggtttaccatctggcacacctcagagtttacctaaagaagatgataagacaaccaaaacaataaaagaacagccacagccaccatgcacagcaaaacctgatcaggtggaacctgggaaagaaaaaacagaaaaggaagatgacaaatcagacacctcaagttctcagcagcctaaaagcccccaaggtctgagcgacacgggatattcttccgatggaatatcaagctcacttggtgaaattccaagtcttattccaactgatgaaaaggatattctcaagggactcaaaaaggactctttttcacaagaaagcagcccttccagcccctcagatttggctaagttagaaagtacagtcctatctattttggaagctcaagcaagtacacttgctgatgaaaagtcagaaaagaaaacacaaccccatgaagtttctcctgaacagcctaaagaccaagagaaaactcagagtttatctgaaaccttggaaattactatttcagaagaggagatcaaagagagtcaagaagaaaggaaagacacttttaaaaaagatagccaacaagatattccttccagcaaggaccataaagagaagtctgagtttgttgatgacataactactagaagagagccttatgattcagttgaagagagtagtgaaagtgaaaactcacctgttccacaaagaaaacgaagaactagtgttggctcatcaagcagtgatgagtataaacaggaagacagccaaggatcaggggaagaggaggacttcattcgaaaacaaatcatagaaatgagtgctgatgaagatgcttcaggttctgaagatgatgagttcatcagaaaccagctcaaagagattagtagcagtactgagagccagaagaaggaagaaacaaagggaaaaggcaaaataacagcagggaaacacagacgactgactcgaaaaagtagcacaagcattgatgaagatgcaggaagacgtcactcatggcatgatgaagacgatgaagcatttgatgaaagtcctgaacttaaatacagagaaactaaaagtcaggaaagtgaagaacttgtagttactggaggaggagggctacgccgatttaaaacaattgagctcaacagtacaatagcagataaatattctgcagagtcatcacagaaaaaaacaagtttgtattttgacgaagagccagaattggaaatggaaagcctgacagactcacctgaagataggtcaaggggagagggatcttcgagtctgcatgcttccagcttcactcctggtacatcccctacatcagtatcatcacttgatgaggacagtgacagtagcccgagtcacaaaaaaggagagagcaaacagcaacgcaaagctcggcacagaccacatggccctcttttgcctactattgaagattcttcagaggaagaagaattgagagaggaagaagaattattaaaggagcaagaaaagcagagggaaatagaacagcaacaaagaaagagttctagtaaaaaatcaaagaaagacaaagatgaacttcgagctcagagaagaagggaaaggccaaagacaccacctagtaatctctctcccattgaagatgcatctccgacagaagagttacgtcaggctgcagaaatggaggagctccatagatcttcttgttctgaatattcacctagcatagagtcagacccagaaggttttgaaataagcccggaaaaaataatagaagtacaaaaagtttataaattgcccacagctgtttcattatactcaccaacagatgagcaatctattatgcagaaagaaggtagccaaaaggcgttaaaaagtgctgaggagatgtatgaagaaatgatgcataaaacacacaaatacaaagcttttccagctgcaaatgaacgagatgaagtgtttgaaaaagagcctttgtatggtgggatgctaatagaggattatatttatgaatctttagtagaagacacgtacaatggatcggtagatggcagtctgctaacaaggcaagaagaagaaaatggatttatgcagcagaaaggaagagagcaaaagataagactttcagaacagatttatgaagatcctatgcagaaaattacagacctccagaaagagttttatgagttagaaagcttacattctgttgtgcctcaggaagatattgtttcaagctcttttatcatcccagaaagccatgagatagtggacctgggtactatggtaacttctacagaagaagaaaggaaactactagatgctgatgctgcctatgaagaacttatgaagaggcaacagatgcaattaacacctggatctagcccaacccaggcccccattggtgaggatatgacagagtccaccatggactttgacagaatgccagatgcctctttgacatcaagtgttctctcaggagcgtctcttacagattcgaccagcagtgcaacactctctatcccagatgttaaaataacccaacatttttcaacagaagaaattgaggatgaatatgtaaccgattatacaagagaaattcaagagataattgcccatgaatcgctgattttgacctactcggagccttcagaaagtgctacatctgtcccaccctctgacacaccttctctcacatcatctgtttcttcggtctgtaccacagatagctcttcacccattactaccctggatagcataaccacagtttatacagagccagtggacatgataactaaatttgaagattctgaggaaatttcttcatcaacttattttccaggcagcattatagactatccagaagaaataagtgtatctttagatcggactgccccaccagatggtagagctagtgctgatcatattgttatttccttatctgatatggcatcttctatcatagaatctgtagtacctaaacctgaagggccagttgctgacactgtttctactgacttacttatatctgaaaaggacccagtgaagaaagccaagaaggaaactgggaatggaatcattctggaagttttggaagcttacagagataaaaaggagttggaggccgaacgaacaaaaagtagcttatccgaaaccgtgtttgatcacccaccttcttctgtaatagcccttccaatgaaagagcagctttcaactacatactttacatctggagagacctttggtcaggaaaaacctgcatctcagttaccatctggcagtccttctgtttcctctcttccagctaaacctcgcccattctttagaagttcttctttggatatatcagctcaacctcctccccctcctccccctccccctcctcctcctcctccaccaccaccccctcctcccccaccacttcctccaccaacttcacctaaaccaactattcttcctaaaaaaaagttaacagttgcatctccagtgactacagctacacctctgtttgatgctgttactactctagagaccacagctgttctgagaagtaatggattacctgttacaagaatatgtactactgcacctcctcctgttcctcctaagccatcttcaattccatctggacttgtatttacccacaggcctgagccaagcaaacctccaatcgcccccaaaccagtgattcctcagcttccaacaactacacaaaaaccaacagatatacaccccaaaccaacaggcctatctttaacttcaagtatgaccttaaatttagtgacttcagcagattataaattgccttcccctacctccccactttccccacactccaacaagtcttcaccaagattttccaaatccctcacagaaacttatgtagttattacattgccatctgaaccagggactccaacagattcttctgctagtcaagcaattaccagttggcccttgggatcaccctccaaagatctggtttctgttgaacctgtgttttctgtagttcctcctgtgacagctgtagaaattccaatttcttcagaacagaccttctacatctctggagctttacagacattttctgctacccctgtcacagcaccctcttcatttcaagcagctcccacatcagttacacagtttctcactactgaagtttccaagactgaggtttcagcaaccagaagtacagctcctagtgttggtctcagcagcatttccataacaattcctccagagcctcttgctctagataacatacatttagagaagcctcagtataaagaagatggaaaattgcaacttgttggtgatgtaattgatttgcgtacagtaccaaaggtagaagttaaaacaactgataaatgtattgatctttctgcttctacaatggatgtgaaaaggcagatcacagcaaatgaagtttatgggaaacaaattagtgctgtccaaccctctattataaatcttagtgtgacatcatcaatagtgactcctgtatctctggccactgagacagtgacctttgtcacatgcacagctagtgcaagttacactacaggcacagaaagcctagtgggtgcagaacatgcaatgacaacaccactccaacttacaacatcaaagcatgctgagcccccatacaggataccaagtgaccaggtctttcctatagctagggaagaagcaccaataaacttatctctaggtactccagcacatgcagtgacattggctattacaaaacctgtcactgtgcctcctgttggtgtcacaaatggatggactgatagcaccgtatcccagggaatcactgatggggaagtagtggatctcagtacaaccaagtctcacagaacagtcgtaacaatggatgagtctacttcaagtgtgatgaccaaaataatagaagatgaaaaacccgttgatttaaccgcagggagaagagctgtgtgctgtgatgtggtttataaattaccatttggaaggagctgcacagcacagcagcctgcaactactcttcctgaggatcgttttggttatagggatgaccactatcagtatgatcgatcagggccatatggttatagagggattgggggaatgaagccttccatgtctgacacaaatttagcagaagctggacattttttctataaaagtaagaatgcttttgattattctgaaggaactgacacagcagtagatctgacttcagggagagttactacaggtgaggtaatggattattcaagcaagactacaggtccatatccagaaacacgacaagtcatttcaggagctgggattagtaccccacagtattccacagcaagaatgacaccaccaccaggaccccagtattgtgtggggagtgttttgaggtcatctaatggtgttgtctattcttcagtagcaactccaacaccctctacatttgctatcaccacacaacctggctccattttcagcaccacagtgagggatttgtctggtattcatacggctgatgcagtgacttcattacctgccatgcaccatagccagccaatgcctagatcatattttataacaacaggtgcatctgaaacggacattgcagtaactggtattgatatcagtgccagtttgcaaactattactatggagtctcttactgctgagacgatagactctgttcccactttaaccacagcatccgaagtgtttcctgaagtggtgggagatgaaagtgctcttttaattgtccctgaagaagataaacaacagcagcagctagacttggagcgtgagctcctggaactggagaaaattaagcaacagcgctttgctgaggaattggagtgggaacgtcaggaaattcaaaggttccgagaacaagaaaagatcatggttcagaaaaagttggaggagctgcagtctatgaagcaacaccttctctttcagcaagaagaagagcggcaagcccagttcatgatgaggcaggagacgttagctcagcaacagttacagcttgagcagatccaacagctgcaacaacagcttcaccagcagctggaggagcaaaagattcggcagatctaccagtataactatgacccttctggaactgcttctccacaaaccactacagagcaggcaattttggaaggtcagtatgctgctctggaaggcagtcaattttgggcaactgaagatgcaaccaccacagcttcagctgttgtggcaattgaaataccacaaagccaaggatggtacaccgttcagtctgatggtgttactcagtacattgccccacctggtatcctgagcactgtttcagaaatacctctaacagatgttgttgtgaaagaggaaaaacaacccaaaaagagaagttctggagctaaagtccgaggacagtatgatgacatgggagaaaatatgacagatgatccccgaagttttaaaaagatagtggacagtggtgtacaaacggatgacgaagatgccacagatcggagctatgtgagtaggagaaggagaactaaaaagagtgtggatacaagcgtccaaactgatgatgaagatcaggatgagtgggatatgcctactagatcaaggaggaaagctcgtgtagggaaatatggtgacagcatgacagaggctgacaagaccaaacccctttccaaagtctccagcatagcagttcaaacggtagcagagatatctgtgcaaactgaaccagttggaaccataagaacaccctccatacgggcacgagtggatgccaaggtagaaataattaaacacatttcagcacctgaaaagacttacaaagggggcagtttaggatgtcaaacagaagcagattcagacacacaaagtcctcaatatctgagtgccacatctccacccaaagacaagaaacgcccaacacctttagagattggttattcatctcacctccgggcagattccacagtacagctggctccttccccacccaaatcccccaaagtcctttactcacccatctcaccactttcaccaggcaaagccttagaatcagcctttgtaccttatgaaaaacccctccctgatgatataagtccacagaaagtactgcatccagatatggctaaagttcccccagcaagtcctaagacagccaagatgatgcagcgttctatgtctgaccccaagcctctgagtccaacagcagacgaaagttccagggctccttttcagtataccgagggctatacgactaaaggttctcaaaccatgacatcctctggagcccagaaaaaagttaaaagaactctgccaaatccacctcctgaggagatttccacaggaactcaatccacattcagcacaatgggcacagtttccaggagaaggatctgcagaaccaacacaatggcacgagccaagattctccaggacatagacagagagcttgatcttgtggaaagggagtctgcaaaacttcgaaagaaacaagcagagcttgatgaagaagaaaaggagattgatgctaagctacgatacctggaaatgggaattaacaggaggaaagaggccctattaaaggagagagaaaagagagaacgagcctacctccagggagtagctgaggatcgtgattacatgtctgacagtgaagtgagtagcacaagaccaacccgaatagaaagtcagcatggcattgagcgaccaagaactgctccccaaactgaattcagccagtttataccaccacaaacccaaacagaatctcaactagttcctccgacaagtccttacacacaataccagtactcttcccctgctcttcctacccaagcacccacctcatacactcaacagtctcattttgagcaacaaactttgtaccatcagcaagtttcaccttatcagactcagccaacattccaagctgtggcaacaatgtccttcacacctcaagttcaacctacaccaaccccacagccttcttatcagttaccttcacagatgatggtgatacaacagaagccacggcaaactacattatatttggagcccaagataacctcaaactatgaagtgattcgcaaccaaccccttatgatagcacctgtttctacggataacacatttgctgtttcccatcttggtagtaagtacaatagtttagacttgagaataggtttggaggaaagaagtagcatggcaagcagtccaatatcaagcatatctgcagattctttctatgcagatattgatcaccatactccacgaaattatgtcctaattgacgacattggagagatcaccaaaggaacagcggcattaagcaccgcatttagccttcatgaaaaggatctgtcaaaaacagaccgtctccttcgaaccactgagacacgccggtctcaagaagtgacagatttcctagcacctttacagtcttcctctagattgcatagttatgtgaaggcggaggaagacccaatggaggatccttacgagttaaagcttctgaaacatcagattaaacaggaatttcgtagagggacagagagcttagatcaccttgctggtctttctcattattaccatgctgatactagctacagacattttccaaaatctgagaagtatagcatcagtagactcacacttgaaaaacaagcagcaaaacaactgccagcagccatactttatcaaaagcagtcaaagcataagaaatcactaattgaccctaaaatgtcaaaattttcacctattcaagaaagtagagaccttgaacctgattattcaagctatatgacttctagcacttcatctattggtggcatttcctccagggcaaggctccttcaagatgacatcacttttggcctcagaaaaaatattacagaccaacaaaaatttatgggatcttctcttggcacaggactgggcacattaggaaataccatacgctcagctctgcaggatgaagcggataagccatacagtagtggcagcaggtccagaccttcctccagaccttcctctgtctatgggcttgatttatcaattaaaagggattcttctagctcttccctaagactgaaagctcaagaggctgaagctctagatgtttcctttagtcatgcatcatcctctgccagaactaagccgaccagtttgccaattagtcaaagtagaggaagaataccaattgtggcccagaattctgaagaagaaagcccactcagtcctgttggccagccaatgggaatggccagggctgcagctggacccctgccaccaatatctgcagacaccagggatcagtttggatcaagccactcattgcctgaagttcagcaacacatgagggaagaatcacggactcgaggctatgaccgtgacatagcattcatcatggatgacttccaacatgccatgtcagacagtgaagcctatcatctgcgtcgtgaggaaacagattggtttgataaacccagggagtctcgtttggaaaatggacatggtctggaccgaaaactgccggaaagattggtccactctagaccactcagtcaacatcaagagcaaattatacagatgaacgggaaaactatgcactacatctttcctcacgcaaggataaaaataacaagagactcaaaggatcacacagtttcaggtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaacaaagcctcccaatcaccggcctgcagaaagctctgtgtccaccggctcctcgggcagcagctttggcagtgggtatagcgtggacagtgaaggaagcagcagcactgcaggggagactaatctatttcctattccgaggatagggaagatgggacagaatggacaagagcctgtaaaacagccaggggtaggagtaggactagcagacactgaagctaaaactcaggtaatgggagaaatcaagattgcattgaagaaggaaatgaagacagatggtgaacaactaatagttgaaattctccaatgcagaaatattacatacaaatttaagtctcctgatcatctaccagatttatatgtgaaaatatatgtgatgaatatttctacccaaaaaaaggtgatcaagaaaaaaacaagagtatgcagacatgatcgagagccttcgtttaatgaaacttttcgattcagtctaagtcctgcaggacattctcttcagattttacttttctccaatggagggaagtttatgaaaaagaccttgattggtgaagcctgtatctggcttgacaaagtggatctcagaaaaagaatagtcaactggcacaaacttttggtcagtcctactcaaacgcattgaagaaacatgtcttctcagggtatagaaactgctctaaatagcctcacatcaagactatagttgaatactattgtacaaagctaagttttgagaggcaaacataagagtgggaacaacaagcaaaaacatacttaagaccttgtacatttattgttgtggatcacacaaagatattcaactgaaaaagttcacatactgaaaacaagaagaatggagttctgagaccttgaatttcccatggctgtgaagagaaactgtgaaacaaattttgattacttaagacaataatctttgagtagagttgagctatagcttaagacaggctcaaagattaatgtggttttcatgcagcacaaaggtaattctttatgcaaaggagccttggttgaaaggaaaggactgatgtaacaaatctcagttttcaaaacttcaaaaatcttccttcatcg

SEQ ID NO: 22610 - DNA, 3267 bp, Homo sapiens
acaaaagtttggaatagtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataaattcctcagcatggcagcttaatgttcatctgttgcctttctttcctgctgtcctttcctgtttgctttcagttttcaacatcctctgctcaccctgttctctgtccctttgtctgtgtaagaacgatataaatacattaatatgctctttcttatttagattttttttatttacatagactgaaataaaactggctgtttctcctttgtttccaccatccatccaacctggctcatagcatttgatacagtgtctgtgatgtttggaagcaaagcaatgttgtgtgtcctttttgtttgcgcttaaatatcttttagaatacagaaattataagcacaagtggctgccagttttccaggacttataccaaaaaaaaaaaagtgcacacatataagtatttagagcagatttgcaattagattcttgtatctgaaaacactcaaaaagtctaggcagaagataatgcaaccaacagtcaacttctagaaccttggaggaaaagccatttcaagacagtgctttaaaacactaacaaattttgcttctgaaatatggtagctttccatgtgcaaaaaattgtagtcttctgaaaaatctgtgaagaaaatcttatttcttacattctcaaaaaactacattaaattaatatatgtataagcatatgtgataaggcaatgcaacctcactgaggagcacaattgggtccattctgttggatcacactttgtatgtgatgacagattttacagatattttttctaaccattggaaatcaagatatactatgtctggtagctataagtcaatcaaagtataacaattgacctatcttaactgctgtattttcatttcatttgtgaaaatttagtcgattgatataattatataaaaacttaatatgtgcaaatatttcacaaatgtaggtaccctgttacttctaaaaggcattagccaggcaatggagatagatcattgttctctccatctccctagtcatcattttcaaagaaacagccagttttaaacccctttagtgctgtgcatgtggtgtcattttggcatttgaaaacacaacctatttaaatagagcaaaagagcacttctgtttgcatgaataacatttaagctggttccatctgaggatacatactctgggtttccatttcacccacactgccacagcagcacataaaagcggtcagtctaatcatgccaggaagcagcacagacacagcatagcaggagtcctccccattcaaagaactcagtctgataatctgcctccaccagccaatggcaaccaagaccaaagccagctagccctcaggaaggtgatgtctgatggaccagtcaagccagaaggaggtgagcagaaaggccctgttcaaagcacacagcaagaacatccccaaatttaaagctctcatctttaatttttagagattgtctgataaaatatgtttatccactttttaatgtgcttttgtgggcatggcatttcaggacttcatcatcaccatgtaagtcccaagatcagtcccgtaatatattgactacagtgatttgtatttttctatgcactgggcatcttttgacttttgttgggaaatagattaacaatattcatattgcagaatggaatgcatgctactaacctaatctgttcaagcatgactataaatatgtttcattgtgataaaagtttaaattgctcacagttcaagttagcctaccagttggaatgtggatcagtgttttttgcctattatttcaagtgtaacttttaaaaatttagtggattttgaaaattcttagaggaaagtaaaggaaaaattgttaatgcactcatttacctttacatggtgaaagttctctcttgatcctacaaacagacattttccactcgtgtttccatagttgttaagtgtatcagatgtgttgggcatgtgaatctccaagtgcctgtgtaataaataaagtatctttatttcattcat

SEQ ID NO: 22611 - DNA, 17144 bp, Homo sapiens
gcggtgcgcggtgggaggggcggacggcgcccggctggcaccgctcagatctgcttctccccggctcggggcgccgaggcggcgtccgggaggtgtcttctgcaaaggttgcctggcgctgtccaacatggaggaggcaccggcagcgggcgttacctgcgagcgggactaacccctgcctggcgttccgggcggcagtgcctggtccagagtccagggactcggctgcctgcacgccccgaggcggaccccggctctgactgctcccctggccgcgggcttctcgactgggacgcggcgcgaggagggagcgcggcggccccgagtctccctgagccatgggcaacgaggcgagcttggaaggggaagggctccccgaagggctggcggcggccgcagcggctggaggaggagctagcggggcggggagcccctctcacaccgcgatcccggccggcatggaggcggatttgagccagctgagcgaagaggagaggagacagatcgccgctgtcatgtcaagggcgcaggggctgcccaagggaagcgtccccccggccgctgcggagtcgccttccatgcacaggaaacaagagttggatagtagtcatcctccaaagcaatcaggaagacccccggaccctgggcgtccagctcaacctggtctcagtaaaagtagaactacagacactttcaggtcagagcagaaattgcctgggaggagtccttccactattagcttgaaagaatcaaagtccagaactgatttaaaggaagagcacaagtctagtatgatgcctggcttcctctcagaggttaacgctttaagtgctgtttcctctgttgtaaataaattcaacccttttgatttgatatcagactctgaggcatcccaggaagaaaccaccaagaaacaaaaagtggttcagaaggagcaaggaaaacctgaaggaatcataaaacctcctttacaacaacagccacccaagccgattcctaagcagcaaggacctggtagggatccgcttcagcaggatggcactcccaaatcaatatcttctcaacaaccagaaaaaattaaatcacaacctccaggtacaggaaagccaattcagggtcctacccagactcctcagacagaccatgcaaaattgccacttcaacgagatgcatccaggcctcagactaaacaggcagacatagtaaggggagaatcagttaaaccctcactgccaagcccatccaaaccacctattcagcaaccaactcctggaaaacctccagcacagcagcctggacatgaaaaatcacagcctgggcctgcaaagcccccagctcagccctcagggctaacaaagccattggctcaacaaccagggacagtgaaacccccagtccagccaccagggacaacaaagcctccagctcagcctcttggtcctgctaagcctccagctcagcagactgggtcagagaagccttcatcggagcagcctgggccaaaggctttagctcagcctcctggagttggaaagactccagctcaacagccagggccagcaaagcctccaacccagcaggtggggacaccaaaacccctagctcaacaacctgggctacagtctccagctaaggcacctgggcctacaaagactccagttcagcagcctgggccaggaaagattccagctcaacaggcaggacccggaaagacttctgcccagcagactggcccaacaaagcctccttcacaactgcctggcccagcaaagcccccacctcaacagcctggcccagcaaagcccccacctcaacagcctggctcagcaaagcccccatctcaacagcctggctcaacaaaacccccacctcaacagcctggcccagcaaagccctcacctcaacagcctggctcaacaaaacccccatctcaacagcctggctcagcaaaaccctcagctcaacagcctagcccagcaaagccctcggctcagcaatctacaaaaccagtaagccaaacaggatctggaaaacctctgcagccaccaacagtgtctccatctgcaaaacagcctccttcacaaggcctccctaaaaccatctgtcctctttgcaataccactgaacttctgttgcatgttccagaaaaggccaattttaacacatgcactgagtgtcaaaccactgtctgtagtctctgtggttttaatcccaatcctcatttaacggaggtaaaagagtggctctgtttgaactgtcaaatgaaaagagctctaggcggggatctggctccagttccgtcatcaccccagcccaaactgaagactgcacctgttaccactacatcagcagtgagcaaatcatccccacagccacagcagacttccccaaagaaggatgctgcaccaaaacaggatctctccaaggcacctgagcctaaaaagccaccaccactagtgaaacaaccaacccttcatggctctccttcagccaaggccaagcagccccctgaggcagattctttgtccaagccagcccctcccaaagaaccttctgtcccatctgagcaggacaaggcccctgttgctgatgataaaccaaagcagcccaagatggtaaagccaaccactgaccttgtatcttcatcatcagcaacaacaaaacctgatattccaagctccaaagtacagtcacaagctgaagagaaaacaacccctcctctaaaaacagactctgccaaaccctcacagagttttccaccaacaggggaaaaagtcagcccatttgattctaaagccatacctcgacctgcatcagattcaaaaattatttcacatcctggtcccagttcagagagcaaaggtcaaaaacaagttgaccccgtacaaaagaaggaagaacccaagaaagcacaaaccaaaatgagtcctaaaccagatgccaagccaatgccaaaagggtcaccaacaccccctggcccacgacctaccgctggccaaactgtccccacacctcaacagtccccaaagcctcaggagcagtcaaggcgtttcagtctgaatctgggaagtattactgatgcccccaaatcacagcctacaactcctcaagagaccgtgactgggaaactctttgggtttggagcatcaatcttcagccaggcatcaaatttaatttccactgcaggccaacctggacctcattcacaaagtggaccaggggccccaatgaaacaagcccctgccccttcacagccacctacttcacaagggccacccaaatccacaggtcaagcaccaccagcacctgcaaaaagtatacctgtgaaaaaggaaacaaaagccccagcagctgaaaaattagagcccaaagctgaacaagctccaacagtaaaaagaacagaaacagaaaaaaagccaccacctattaaggatagcaaatctttaacagctgagcctcaaaaggctgtccttcccacaaaactggagaaatcgcccaaaccagaatcaacctgtcctctctgcaaaactgaactcaacataggttctaaggatcctcctaacttcaatacttgcactgaatgcaagaatcaagtgtgtaatctctgtggatttaaccctacaccacatttgactgagattcaagaatggctttgtttaaattgccaaacccagagagcaatatcaggacagcttggagacatacgcaaaatgccacctgcaccatcaggacccaaagcatctcctatgcctgttcctacagaatcatcatctcagaaaacagcagtgcctccccaagtaaaattagtgaaaaagcaagaacaagaagtaaaaacggaagctgaaaaagtcattctggaaaaagtaaaggaaacactatcaatggaaaaaattcctcctatggtaaccacagatcaaaaacaagaagagagtaaactagagaaagacaaagcttcagctcttcaagaaaaaaagccactccctgaagaaaaaaaactaatccctgaagaagaaaagatacgttctgaagaaaaaaagccactcctagaagaaaaaaagccaacccctgaagacaaaaagctactcccagaggcaaaaacatcagccccagaagaacagaaacatgacttacttaaatctcaagtacaaattgctgaagaaaagcttgaaggcagagtggctccaaagacagtgcaagaagggaaacaaccacagaccaagatggaaggtttaccatctggcacacctcagagtttacctaaagaagatgataagacaaccaaaacaataaaagaacagccacagccaccatgcacagcaaaacctgatcaggtggaacctgggaaagaaaaaacagaaaaggaagatgacaaatcagacacctcaagttctcagcagcctaaaagcccccaaggtctgagcgacacgggatattcttccgatggaatatcaagctcacttggtgaaattccaagtcttattccaactgatgaaaaggatattctcaagggactcaaaaaggactctttttcacaagaaagcagcccttccagcccctcagatttggctaagttagaaagtacagtcctatctattttggaagctcaagcaagtacacttgctgatgaaaagtcagaaaagaaaacacaaccccatgaagtttctcctgaacagcctaaagaccaagagaaaactcagagtttatctgaaaccttggaaattactatttcagaagaggagatcaaagagagtcaagaagaaaggaaagacacttttaaaaaagatagccaacaagatattccttccagcaaggaccataaagagaagtctgagtttgttgatgacataactactagaagagagccttatgattcagttgaagagagtagtgaaagtgaaaactcacctgttccacaaagaaaacgaagaactagtgttggctcatcaagcagtgatgagtataaacaggaagacagccaaggatcaggggaagaggaggacttcattcgaaaacaaatcatagaaatgagtgctgatgaagatgcttcaggttctgaagatgatgagttcatcagaaaccagctcaaagagattagtagcagtactgagagccagaagaaggaagaaacaaagggaaaaggcaaaataacagcagggaaacacagacgactgactcgaaaaagtagcacaagcattgatgaagatgcaggaagacgtcactcatggcatgatgaagacgatgaagcatttgatgaaagtcctgaacttaaatacagagaaactaaaagtcaggaaagtgaagaacttgtagttactggaggaggagggctacgccgatttaaaacaattgagctcaacagtacaatagcagataaatattctgcagagtcatcacagaaaaaaacaagtttgtattttgacgaagagccagaattggaaatggaaagcctgacagactcacctgaagataggtcaaggggagagggatcttcgagtctgcatgcttccagcttcactcctggtacatcccctacatcagtatcatcacttgatgaggacagtgacagtagcccgagtcacaaaaaaggagagagcaaacagcaacgcaaagctcggcacagaccacatggccctcttttgcctactattgaagattcttcagaggaagaagaattgagagaggaagaagaattattaaaggagcaagaaaagcagagggaaatagaacagcaacaaagaaagagttctagtaaaaaatcaaagaaagacaaagatgaacttcgagctcagagaagaagggaaaggccaaagacaccacctagtaatctctctcccattgaagatgcatctccgacagaagagttacgtcaggctgcagaaatggaggagctccatagatcttcttgttctgaatattcacctagcatagagtcagacccagaaggttttgaaataagcccggaaaaaataatagaagtacaaaaagtttataaattgcccacagctgtttcattatactcaccaacagatgagcaatctattatgcagaaagaaggtagccaaaaggcgttaaaaagtgctgaggagatgtatgaagaaatgatgcataaaacacacaaatacaaagcttttccagctgcaaatgaacgagatgaagtgtttgaaaaagagcctttgtatggtgggatgctaatagaggattatatttatgaatctttagtagaagacacgtacaatggatcggtagatggcagtctgctaacaaggcaagaagaagaaaatggatttatgcagcagaaaggaagagagcaaaagataagactttcagaacagatttatgaagatcctatgcagaaaattacagacctccagaaagagttttatgagttagaaagcttacattctgttgtgcctcaggaagatattgtttcaagctcttttatcatcccagaaagccatgagatagtggacctgggtactatggtaacttctacagaagaagaaaggaaactactagatgctgatgctgcctatgaagaacttatgaagaggcaacagatgcaattaacacctggatctagcccaacccaggcccccattggtgaggatatgacagagtccaccatggactttgacagaatgccagatgcctctttgacatcaagtgttctctcaggagcgtctcttacagattcgaccagcagtgcaacactctctatcccagatgttaaaataacccaacatttttcaacagaagaaattgaggatgaatatgtaaccgattatacaagagaaattcaagagataattgcccatgaatcgctgattttgacctactcggagccttcagaaagtgctacatctgtcccaccctctgacacaccttctctcacatcatctgtttcttcggtctgtaccacagatagctcttcacccattactaccctggatagcataaccacagtttatacagagccagtggacatgataactaaatttgaagattctgaggaaatttcttcatcaacttattttccaggcagcattatagactatccagaagaaataagtgtatctttagatcggactgccccaccagatggtagagctagtgctgatcatattgttatttccttatctgatatggcatcttctatcatagaatctgtagtacctaaacctgaagggccagttgctgacactgtttctactgacttacttatatctgaaaaggacccagtgaagaaagccaagaaggaaactgggaatggaatcattctggaagttttggaagcttacagagataaaaaggagttggaggccgaacgaacaaaaagtagcttatccgaaaccgtgtttgatcacccaccttcttctgtaatagcccttccaatgaaagagcagctttcaactacatactttacatctggagagacctttggtcaggaaaaacctgcatctcagttaccatctggcagtccttctgtttcctctcttccagctaaacctcgcccattctttagaagttcttctttggatatatcagctcaacctcctccccctcctccccctccccctcctcctcctcctccaccaccaccccctcctcccccaccacttcctccaccaacttcacctaaaccaactattcttcctaaaaaaaagttaacagttgcatctccagtgactacagctacacctctgtttgatgctgttactactctagagaccacagctgttctgagaagtaatggattacctgttacaagaatatgtactactgcacctcctcctgttcctcctaagccatcttcaattccatctggacttgtatttacccacaggcctgagccaagcaaacctccaatcgcccccaaaccagtgattcctcagcttccaacaactacacaaaaaccaacagatatacaccccaaaccaacaggcctatctttaacttcaagtatgaccttaaatttagtgacttcagcagattataaattgccttcccctacctccccactttccccacactccaacaagtcttcaccaagattttccaaatccctcacagaaacttatgtagttattacattgccatctgaaccagggactccaacagattcttctgctagtcaagcaattaccagttggcccttgggatcaccctccaaagatctggtttctgttgaacctgtgttttctgtagttcctcctgtgacagctgtagaaattccaatttcttcagaacagaccttctacatctctggagctttacagacattttctgctacccctgtcacagcaccctcttcatttcaagcagctcccacatcagttacacagtttctcactactgaagtttccaagactgaggtttcagcaaccagaagtacagctcctagtgttggtctcagcagcatttccataacaattcctccagagcctcttgctctagataacatacatttagagaagcctcagtataaagaagatggaaaattgcaacttgttggtgatgtaattgatttgcgtacagtaccaaaggtagaagttaaaacaactgataaatgtattgatctttctgcttctacaatggatgtgaaaaggcagatcacagcaaatgaagtttatgggaaacaaattagtgctgtccaaccctctattataaatcttagtgtgacatcatcaatagtgactcctgtatctctggccactgagacagtgacctttgtcacatgcacagctagtgcaagttacactacaggcacagaaagcctagtgggtgcagaacatgcaatgacaacaccactccaacttacaacatcaaagcatgctgagcccccatacaggataccaagtgaccaggtctttcctatagctagggaagaagcaccaataaacttatctctaggtactccagcacatgcagtgacattggctattacaaaacctgtcactgtgcctcctgttggtgtcacaaatggatggactgatagcaccgtatcccagggaatcactgatggggaagtagtggatctcagtacaaccaagtctcacagaacagtcgtaacaatggatgagtctacttcaagtgtgatgaccaaaataatagaagatgaaaaacccgttgatttaaccgcagggagaagagctgtgtgctgtgatgtggtttataaattaccatttggaaggagctgcacagcacagcagcctgcaactactcttcctgaggatcgttttggttatagggatgaccactatcagtatgatcgatcagggccatatggttatagagggattgggggaatgaagccttccatgtctgacacaaatttagcagaagctggacattttttctataaaagtaagaatgcttttgattattctgaaggaactgacacagcagtagatctgacttcagggagagttactacaggtgaggtaatggattattcaagcaagactacaggtccatatccagaaacacgacaagtcatttcaggagctgggattagtaccccacagtattccacagcaagaatgacaccaccaccaggaccccagtattgtgtggggagtgttttgaggtcatctaatggtgttgtctattcttcagtagcaactccaacaccctctacatttgctatcaccacacaacctggctccattttcagcaccacagtgagggatttgtctggtattcatacggctgatgcagtgacttcattacctgccatgcaccatagccagccaatgcctagatcatattttataacaacaggtgcatctgaaacggacattgcagtaactggtattgatatcagtgccagtttgcaaactattactatggagtctcttactgctgagacgatagactctgttcccactttaaccacagcatccgaagtgtttcctgaagtggtgggagatgaaagtgctcttttaattgtccctgaagaagataaacaacagcagcagctagacttggagcgtgagctcctggaactggagaaaattaagcaacagcgctttgctgaggaattggagtgggaacgtcaggaaattcaaaggttccgagaacaagaaaagatcatggttcagaaaaagttggaggagctgcagtctatgaagcaacaccttctctttcagcaagaagaagagcggcaagcccagttcatgatgaggcaggagacgttagctcagcaacagttacagcttgagcagatccaacagctgcaacaacagcttcaccagcagctggaggagcaaaagattcggcagatctaccagtataactatgacccttctggaactgcttctccacaaaccactacagagcaggcaattttggaaggtcagtatgctgctctggaaggcagtcaattttgggcaactgaagatgcaaccaccacagcttcagctgttgtggcaattgaaataccacaaagccaaggatggtacaccgttcagtctgatggtgttactcagtacattgccccacctggtatcctgagcactgtttcagaaatacctctaacagatgttgttgtgaaagaggaaaaacaacccaaaaagagaagttctggagctaaagtccgaggacagtatgatgacatgggagaaaatatgacagatgatccccgaagttttaaaaagatagtggacagtggtgtacaaacggatgacgaagatgccacagatcggagctatgtgagtaggagaaggagaactaaaaagagtgtggatacaagcgtccaaactgatgatgaagatcaggatgagtgggatatgcctactagatcaaggaggaaagctcgtgtagggaaatatggtgacagcatgacagaggctgacaagaccaaacccctttccaaagtctccagcatagcagttcaaacggtagcagagatatctgtgcaaactgaaccagttggaaccataagaacaccctccatacgggcacgagtggatgccaaggtagaaataattaaacacatttcagcacctgaaaagacttacaaagggggcagtttaggatgtcaaacagaagcagattcagacacacaaagtcctcaatatctgagtgccacatctccacccaaagacaagaaacgcccaacacctttagagattggttattcatctcacctccgggcagattccacagtacagctggctccttccccacccaaatcccccaaagtcctttactcacccatctcaccactttcaccaggcaaagccttagaatcagcctttgtaccttatgaaaaacccctccctgatgatataagtccacagaaagtactgcatccagatatggctaaagttcccccagcaagtcctaagacagccaagatgatgcagcgttctatgtctgaccccaagcctctgagtccaacagcagacgaaagttccagggctccttttcagtataccgagggctatacgactaaaggttctcaaaccatgacatcctctggagcccagaaaaaagttaaaagaactctgccaaatccacctcctgaggagatttccacaggaactcaatccacattcagcacaatgggcacagtttccaggagaaggatctgcagaaccaacacaatggcacgagccaagattctccaggacatagacagagagcttgatcttgtggaaagggagtctgcaaaacttcgaaagaaacaagcagagcttgatgaagaagaaaaggagattgatgctaagctacgatacctggaaatgggaattaacaggaggaaagaggccctattaaaggagagagaaaagagagaacgagcctacctccagggagtagctgaggatcgtgattacatgtctgacagtgaagtgagtagcacaagaccaacccgaatagaaagtcagcatggcattgagcgaccaagaactgctccccaaactgaattcagccagtttataccaccacaaacccaaacagaatctcaactagttcctccgacaagtccttacacacaataccagtactcttcccctgctcttcctacccaagcacccacctcatacactcaacagtctcattttgagcaacaaactttgtaccatcagcaagtttcaccttatcagactcagccaacattccaagctgtggcaacaatgtccttcacacctcaagttcaacctacaccaaccccacagccttcttatcagttaccttcacagatgatggtgatacaacagaagccacggcaaactacattatatttggagcccaagataacctcaaactatgaagtgattcgcaaccaaccccttatgatagcacctgtttctacggataacacatttgctgtttcccatcttggtagtaagtacaatagtttagacttgagaataggtttggaggaaagaagtagcatggcaagcagtccaatatcaagcatatctgcagattctttctatgcagatattgatcaccatactccacgaaattatgtcctaattgacgacattggagagatcaccaaaggaacagcggcattaagcaccgcatttagccttcatgaaaaggatctgtcaaaaacagaccgtctccttcgaaccactgagacacgccggtctcaagaagtgacagatttcctagcacctttacagtcttcctctagattgcatagttatgtgaaggcggaggaagacccaatggaggatccttacgagttaaagcttctgaaacatcagattaaacaggaatttcgtagagggacagagagcttagatcaccttgctggtctttctcattattaccatgctgatactagctacagacattttccaaaatctgagaagtatagcatcagtagactcacacttgaaaaacaagcagcaaaacaactgccagcagccatactttatcaaaagcagtcaaagcataagaaatcactaattgaccctaaaatgtcaaaattttcacctattcaagaaagtagagaccttgaacctgattattcaagctatatgacttctagcacttcatctattggtggcatttcctccagggcaaggctccttcaagatgacatcacttttggcctcagaaaaaatattacagaccaacaaaaatttatgggatcttctcttggcacaggactgggcacattaggaaataccatacgctcagctctgcaggatgaagcggataagccatacagtagtggcagcaggtccagaccttcctccagaccttcctctgtctatgggcttgatttatcaattaaaagggattcttctagctcttccctaagactgaaagctcaagaggctgaagctctagatgtttcctttagtcatgcatcatcctctgccagaactaagccgaccagtttgccaattagtcaaagtagaggaagaataccaattgtggcccagaattctgaagaagaaagcccactcagtcctgttggccagccaatgggaatggccagggctgcagctggacccctgccaccaatatctgcagacaccagggatcagtttggatcaagccactcattgcctgaagttcagcaacacatgagggaagaatcacggactcgaggctatgaccgtgacatagcattcatcatggatgacttccaacatgccatgtcagacagtgaagcctatcatctgcgtcgtgaggaaacagattggtttgataaacccagggagtctcgtttggaaaatggacatggtctggaccgaaaactgccggaaagattggtccactctagaccactcagtcaacatcaagagcaaattatacagatgaacgggaaaactatgcactacatctttcctcacgcaaggataaaaataacaagagactcaaaggatcacacagtttcaggtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaagtaaaagacgcaaataaattcctcagcatggcagcttaatgttcatctgttgcctttctttcctgctgtcctttcctgtttgctttcagttttcaacatcctctgctcaccctgttctctgtccctttgtctgtgtaagaacgatataaatacattaatatgctctttcttatttagattttttttatttacatagactgaaataaaactggctgtttctcctttgtttccaccatccatccaacctggctcatagcatttgatacagtgtctgtgatgtttggaagcaaagcaatgttgtgtgtcctttttgtttgcgcttaaatatcttttagaatacagaaattataagcacaagtggctgccagttttccaggacttataccaaaaaaaaaaaagtgcacacatataagtatttagagcagatttgcaattagattcttgtatctgaaaacactcaaaaagtctaggcagaagataatgcaaccaacagtcaacttctagaaccttggaggaaaagccatttcaagacagtgctttaaaacactaacaaattttgcttctgaaatatggtagctttccatgtgcaaaaaattgtagtcttctgaaaaatctgtgaagaaaatcttatttcttacattctcaaaaaactacattaaattaatatatgtataagcatatgtgataaggcaatgcaacctcactgaggagcacaattgggtccattctgttggatcacactttgtatgtgatgacagattttacagatattttttctaaccattggaaatcaagatatactatgtctggtagctataagtcaatcaaagtataacaattgacctatcttaactgctgtattttcatttcatttgtgaaaatttagtcgattgatataattatataaaaacttaatatgtgcaaatatttcacaaatgtaggtaccctgttacttctaaaaggcattagccaggcaatggagatagatcattgttctctccatctccctagtcatcattttcaaagaaacagccagttttaaacccctttagtgctgtgcatgtggtgtcattttggcatttgaaaacacaacctatttaaatagagcaaaagagcacttctgtttgcatgaataacatttaagctggttccatctgaggatacatactctgggtttccatttcacccacactgccacagcagcacataaaagcggtcagtctaatcatgccaggaagcagcacagacacagcatagcaggagtcctccccattcaaagaactcagtctgataatctgcctccaccagccaatggcaaccaagaccaaagccagctagccctcaggaaggtgatgtctgatggaccagtcaagccagaaggaggtgagcagaaaggccctgttcaaagcacacagcaagaacatccccaaatttaaagctctcatctttaatttttagagattgtctgataaaatatgtttatccactttttaatgtgcttttgtgggcatggcatttcaggacttcatcatcaccatgtaagtcccaagatcagtcccgtaatatattgactacagtgatttgtatttttctatgcactgggcatcttttgacttttgttgggaaatagattaacaatattcatattgcagaatggaatgcatgctactaacctaatctgttcaagcatgactataaatatgtttcattgtgataaaagtttaaattgctcacagttcaagttagcctaccagttggaatgtggatcagtgttttttgcctattatttcaagtgtaacttttaaaaatttagtggattttgaaaattcttagaggaaagtaaaggaaaaattgttaatgcactcatttacctttacatggtgaaagttctctcttgatcctacaaacagacattttccactcgtgtttccatagttgttaagtgtatcagatgtgttgggcatgtgaatctccaagtgcctgtgtaataaataaagtatctttatttcattcat

SEQ ID NO: 22612 - DNA, 20081 bp, Homo sapiens
tctgcttctccccggctcggggcgccgaggcggcgtccgggaggtgtcttctgcaaaggttgcctggcgctgtccaacatggaggaggcaccggcagcgggcgttacctgcgagcgggactaacccctgcctggcgttccgggcggcagtgcctggtccagagtccagggactcggctgcctgcacgccccgaggcggaccccggctctgactgctcccctggccgcgggcttctcgactgggacgcggcgcgaggagggagcgcggcggccccgagtctccctgagccatgggcaacgaggcgagcttggaaggggaagggctccccgaagggctggcggcggccgcagcggctggaggaggagctagcggggcggggagcccctctcacaccgcgatcccggccggcatggaggcggatttgagccagctgagcgaagaggagaggagacagatcgccgctgtcatgtcaagggcgcaggggctgcccaagggaagcgtccccccggccgctgcggagtcgccttccatgcacaggaaacaagagttggatagtagtcatcctccaaagcaatcaggaagacccccggaccctgggcgtccagctcaacctggtctcagtaaaagtagaactacagacactttcaggtcagagcagaaattgcctgggaggagtccttccactattagcttgaaagaatcaaagtccagaactgatttaaaggaagagcacaagtctagtatgatgcctggcttcctctcagaggttaacgctttaagtgctgtttcctctgttgtaaataaattcaacccttttgatttgatatcagactctgaggcatcccaggaagaaaccaccaagaaacaaaaagtggttcagaaggagcaaggaaaacctgaaggaatcataaaacctcctttacaacaacagccacccaagccgattcctaagcagcaaggacctggtagggatccgcttcagcaggatggcactcccaaatcaatatcttctcaacaaccagaaaaaattaaatcacaacctccaggtacaggaaagccaattcagggtcctacccagactcctcagacagaccatgcaaaattgccacttcaacgagatgcatccaggcctcagactaaacaggcagacatagtaaggggagaatcagttaaaccctcactgccaagcccatccaaaccacctattcagcaaccaactcctggaaaacctccagcacagcagcctggacatgaaaaatcacagcctgggcctgcaaagcccccagctcagccctcagggctaacaaagccattggctcaacaaccagggacagtgaaacccccagtccagccaccagggacaacaaagcctccagctcagcctcttggtcctgctaagcctccagctcagcagactgggtcagagaagccttcatcggagcagcctgggccaaaggctttagctcagcctcctggagttggaaagactccagctcaacagccagggccagcaaagcctccaacccagcaggtggggacaccaaaacccctagctcaacaacctgggctacagtctccagctaaggcacctgggcctacaaagactccagttcagccaaagcccccatctcaacagcctggctcaacaaaacccccacctcaacagcctggcccagcaaagccctcacctcaacagcctggctcaacaaaacccccatctcaacagcctggctcagcaaaaccctcagctcaacagcctagcccagcaaagccctcggctcagcaatctacaaaaccagtaagccaaacaggatctggaaaacctctgcagccaccaacagtgtctccatctgcaaaacagcctccttcacaaggcctccctaaaaccatctgtcctctttgcaataccactgaacttctgttgcatgttccagaaaaggccaattttaacacatgcactgagtgtcaaaccactgtctgtagtctctgtggttttaatcccaatcctcatttaacggaggtaaaagagtggctctgtttgaactgtcaaatgaaaagagctctaggcggggatctggctccagttccgtcatcaccccagcccaaactgaagactgcacctgttaccactacatcagcagtgagcaaatcatccccacagccacagcagacttccccaaagaaggatgctgcaccaaaacaggatctctccaaggcacctgagcctaaaaagccaccaccactagtgaaacaaccaacccttcatggctctccttcagccaaggccaagcagccccctgaggcagattctttgtccaagccagcccctcccaaagaaccttctgtcccatctgagcaggacaaggcccctgttgctgatgataaaccaaagcagcccaagatggtaaagccaaccactgaccttgtatcttcatcatcagcaacaacaaaacctgatattccaagctccaaagtacagtcacaagctgaagagaaaacaacccctcctctaaaaacagactctgccaaaccctcacagagttttccaccaacaggggaaaaagtcagcccatttgattctaaagccatacctcgacctgcatcagattcaaaaattatttcacatcctggtcccagttcagagagcaaaggtcaaaaacaagttgaccccgtacaaaagaaggaagaacccaagaaagcacaaaccaaaatgagtcctaaaccagatgccaagccaatgccaaaagggtcaccaacaccccctggcccacgacctaccgctggccaaactgtccccacacctcaacagtccccaaagcctcaggagcagtcaaggcgtttcagtctgaatctgggaagtattactgatgcccccaaatcacagcctacaactcctcaagagaccgtgactgggaaactctttgggtttggagcatcaatcttcagccaggcatcaaatttaatttccactgcaggccaacctggacctcattcacaaagtggaccaggggccccaatgaaacaagcccctgccccttcacagccacctacttcacaagggccacccaaatccacaggtcaagcaccaccagcacctgcaaaaagtatacctgtgaaaaaggaaacaaaagccccagcagctgaaaaattagagcccaaagctgaacaagctccaacagtaaaaagaacagaaacagaaaaaaagccaccacctattaaggatagcaaatctttaacagctgagcctcaaaaggctgtccttcccacaaaactggagaaatcgcccaaaccagaatcaacctgtcctctctgcaaaactgaactcaacataggttctaaggatcctcctaacttcaatacttgcactgaatgcaagaatcaagtgtgtaatctctgtggatttaaccctacaccacatttgactgagaattgccaaacccagagagcaatatcaggacagcttggagacatacgcaaaatgccacctgcaccatcaggacccaaagcatctcctatgcctgttcctacagaatcatcatctcagaaaacagcagtgcctccccaagtaaaattagtgaaaaagcaagaacaagaagtaaaaacggaagctgaaaaagtcattctggaaaaagtaaaggaaacactatcaatggaaaaaattcctcctatggtaaccacagatcaaaaacaagaagagagtaaactagagaaagacaaagcttcagctcttcaagaaaaaaagccactccctgaagaaaaaaaactaatccctgaagaagaaaagatacgttctgaagaaaaaaagccactcctagaagaaaaaaagccaacccctgaagacaaaaagctactcccagaggcaaaaacatcagccccagaagaacagaaacatgacttacttaaatctcaagtacaaattgctgaagaaaagcttgaaggcagagtggctccaaagacagtgcaagaagggaaacaaccacagaccaagatggaaggtttaccatctggcacacctcagagtttacctaaagaagatgataagacaaccaaaacaataaaagaacagccacagccaccatgcacagcaaaacctgatcaggaaaaggaagatgacaaatcagacacctcaagttctcagcagcctaaaagcccccaaggtctgagcgacacgggatattcttccgatggaatatcaagctcacttggtgaaattccaagtcttattccaactgatgaaaaggatattctcaagggactcaaaaaggactctttttcacaagaaagcagcccttccagcccctcagatttggctaagttagaaagtacagtcctatctattttggaagctcaagcaagtacacttgctgatgaaaagtcagaaaagaaaacacaaccccatgaagtttctcctgaacagcctaaagaccaagagaaaactcagagtttatctgaaaccttggaaattactatttcagaagaggagatcaaagagagtcaagaagaaaggaaagacacttttaaaaaagatagccaacaagatattccttccagcaaggaccataaagagaagtctgagtttgttgatgacataactactagaagagagccttatgattcagttgaagagagtagtgaaagtgaaaactcacctgttccacaaagaaaacgaagaactagtgttggctcatcaagcagtgatgagtataaacaggaagacagccaaggatcaggggaagaggaggacttcattcgaaaacaaatcatagaaatgagtgctgatgaagatgcttcaggttctgaagatgatgagttcatcagaaaccagctcaaagagattagtagcagtactgagagccagaagaaggaagaaacaaagggaaaaggcaaaataacagcagggaaacacagacgactgactcgaaaaagtagcacaagcattgatgaagatgcaggaagacgtcactcatggcatgatgaagacgatgaagcatttgatgaaagtcctgaacttaaatacagagaaactaaaagtcaggaaagtgaagaacttgtagttactggaggaggagggctacgccgatttaaaacaattgagctcaacagtacaatagcagataaatattctgcagagtcatcacagaaaaaaacaagtttgtattttgacgaagagccagaattggaaatggaaagcctgacagactcacctgaagataggtcaaggggagagggatcttcgagtctgcatgcttccagcttcactcctggtacatcccctacatcagtatcatcacttgatgaggacagtgacagtagcccgagtcacaaaaaaggagagagcaaacagcaacgcaaagctcggcacagaccacatggccctcttttgcctactattgaagattcttcagaggaagaagaattgagagaggaagaagaattattaaaggagcaagaaaagcagagggaaatagaacagcaacaaagaaagagttctagtaaaaaatcaaagaaagacaaagatgaacttcgagctcagagaagaagggaaaggccaaagacaccacctagtaatctctctcccattgaagatgcatctccgacagaagagttacgtcaggctgcagaaatggaggagctccatagatcttcttgttctgaatattcacctagcatagagtcagacccagaaggttttgaaataagcccggaaaaaataatagaagtacaaaaagtttataaattgcccacagctgtttcattatactcaccaacagatgagcaatctattatgcagaaagaaggtagccaaaaggcgttaaaaagtgctgaggagatgtatgaagaaatgatgcataaaacacacaaatacaaagcttttccagctgcaaatgaacgagatgaagtgtttgaaaaagagcctttgtatggtgggatgctaatagaggattatatttatgaatctttagtagaagacacgtacaatggatcggtagatggcagtctgctaacaaggcaagaagaagaaaatggatttatgcagcagaaaggaagagagcaaaagataagactttcagaacagatttatgaagatcctatgcagaaaattacagacctccagaaagagttttatgagttagaaagcttacattctgttgtgcctcaggaagatattgtttcaagctcttttatcatcccagaaagccatgagatagtggacctgggtactatggtaacttctacagaagaagaaaggaaactactagatgctgatgctgcctatgaagaacttatgaagaggcaacagatgcaattaacacctggatctagcccaacccaggcccccattggtgaggatatgacagagtccaccatggactttgacagaatgccagatgcctctttgacatcaagtgttctctcaggagcgtctcttacagattcgaccagcagtgcaacactctctatcccagatgttaaaataacccaacatttttcaacagaagaaattgaggatgaatatgtaaccgattatacaagagaaattcaagagataattgcccatgaatcgctgattttgacctactcggagccttcagaaagtgctacatctgtcccaccctctgacacaccttctctcacatcatctgtttcttcggtctgtaccacagatagctcttcacccattactaccctggatagcataaccacagtttatacagagccagtggacatgataactaaatttgaagattctgaggaaatttcttcatcaacttattttccaggcagcattatagactatccagaagaaataagtgtatctttagatcggactgccccaccagatggtagagctagtgctgatcatattgttatttccttatctgatatggcatcttctatcatagaatctgtagtacctaaacctgaagggccagttgctgacactgtttctactgacttacttatatctgaaaaggacccagtgaagaaagccaagaaggaaactgggaatggaatcattctggaagttttggaagcttacagagataaaaaggagttggaggccgaacgaacaaaaagtagcttatccgaaaccgtgtttgatcacccaccttcttctgtaatagcccttccaatgaaagagcagctttcaactacatactttacatctggagagacctttggtcaggaaaaacctgcatctcagttaccatctggcagtccttctgtttcctctcttccagctaaacctcgcccattctttagaagttcttctttggatatatcagctcaacctcctccccctcctccccctccccctcctcctcctcctccaccaccaccccctcctcccccaccacttcctccaccaacttcacctaaaccaactattcttcctaaaaaaaagttaacagttgcatctccagtgactacagctacacctctgtttgatgctgttactactctagagaccacagctgttctgagaagtaatggattacctgttacaagaatatgtactactgcacctcctcctgttcctcctaagccatcttcaattccatctggacttgtatttacccacaggcctgagccaagcaaacctccaatcgcccccaaaccagtgattcctcagcttccaacaactacacaaaaaccaacagatatacaccccaaaccaacaggcctatctttaacttcaagtatgaccttaaatttagtgacttcagcagattataaattgccttcccctacctccccactttccccacactccaacaagtcttcaccaagattttccaaatccctcacagaaacttatgtagttattacattgccatctgaaccagggactccaacagattcttctgctagtcaagcaattaccagttggcccttgggatcaccctccaaagatctggtttctgttgaacctgtgttttctgtagttcctcctgtgacagctgtagaaattccaatttcttcagaacagaccttctacatctctggagctttacagacattttctgctacccctgtcacagcaccctcttcatttcaagcagctcccacatcagttacacagtttctcactactgaagtttccaagactgaggtttcagcaaccagaagtacagctcctagtgttggtctcagcagcatttccataacaattcctccagagcctcttgctctagataacatacatttagagaagcctcagtataaagaagatggaaaattgcaacttgttggtgatgtaattgatttgcgtacagtaccaaaggtagaagttaaaacaactgataaatgtattgatctttctgcttctacaatggatgtgaaaaggcagatcacagcaaatgaagtttatgggaaacaaattagtgctgtccaaccctctattataaatcttagtgtgacatcatcaatagtgactcctgtatctctggccactgagacagtgacctttgtcacatgcacagctagtgcaagttacactacaggcacagaaagcctagtgggtgcagaacatgcaatgacaacaccactccaacttacaacatcaaagcatgctgagcccccatacaggataccaagtgaccaggtctttcctatagctagggaagaagcaccaataaacttatctctaggtactccagcacatgcagtgacattggctattacaaaacctgtcactgtgcctcctgttggtgtcacaaatggatggactgatagcaccgtatcccagggaatcactgatggggaagtagtggatctcagtacaaccaagtctcacagaacagtcgtaacaatggatgagtctacttcaagtgtgatgaccaaaataatagaagatgaaaaacccgttgatttaaccgcagggagaagagctgtgtgctgtgatgtggtttataaattaccatttggaaggagctgcacagcacagcagcctgcaactactcttcctgaggatcgttttggttatagggatgaccactatcagtatgatcgatcagggccatatggttatagagggattgggggaatgaagccttccatgtctgacacaaatttagcagaagctggacattttttctataaaagtaagaatgcttttgattattctgaaggaactgacacagcagtagatctgacttcagggagagttactacaggtgaggtaatggattattcaagcaagactacaggtccatatccagaaacacgacaagtcatttcaggagctgggattagtaccccacagtattccacagcaagaatgacaccaccaccaggaccccagtattgtgtggggagtgttttgaggtcatctaatggtgttgtctattcttcagtagcaactccaacaccctctacatttgctatcaccacacaacctggctccattttcagcaccacagtgagggatttgtctggtattcatacggctgatgcagtgacttcattacctgccatgcaccatagccagccaatgcctagatcatattttataacaacaggtgcatctgaaacggacattgcagtaactggtattgatatcagtgccagtttgcaaactattactatggagtctcttactgctgagacgatagactctgttcccactttaaccacagcatccgaagtgtttcctgaagtggtgggagatgaaagtgctcttttaattgtccctgaagaagataaacaacagcagcagctagacttggagcgtgagctcctggaactggagaaaattaagcaacagcgctttgctgaggaattggagtgggaacgtcaggaaattcaaaggttccgagaacaagaaaagatcatggttcagaaaaagttggaggagctgcagtctatgaagcaacaccttctctttcagcaagaagaagagcggcaagcccagttcatgatgaggcaggagacgttagctcagcaacagttacagcttgagcagatccaacagctgcaacaacagcttcaccagcagctggaggagcaaaagattcggcagatctaccagtataactatgacccttctggaactgcttctccacaaaccactacagagcaggcaattttggaaggtcagtatgctgctctggaaggcagtcaattttgggcaactgaagatgcaaccaccacagcttcagctgttgtggcaattgaaataccacaaagccaaggatggtacaccgttcagtctgatggtgttactcagtacattgccccacctggtatcctgagcactgtttcagaaatacctctaacagatgttgttgtgaaagaggaaaaacaacccaaaaagagaagttctggagctaaagtccgaggacagtatgatgacatgggagaaaatatgacagatgatccccgaagttttaaaaagatagtggacagtggtgtacaaacggatgacgaagatgccacagatcggagctatgtgagtaggagaaggagaactaaaaagagtgtggatacaagcgtccaaactgatgatgaagatcaggatgagtgggatatgcctactagatcaaggaggaaagctcgtgtagggaaatatggtgacagcatgacagaggctgacaagaccaaacccctttccaaagtctccagcatagcagttcaaacggtagcagagatatctgtgcaaactgaaccagttggaaccataagaacaccctccatacgggcacgagtggatgccaaggtagaaataattaaacacatttcagcacctgaaaagacttacaaagggggcagtttaggatgtcaaacagaagcagattcagacacacaaagtcctcaatatctgagtgccacatctccacccaaagacaagaaacgcccaacacctttagagattggttattcatctcacctccgggcagattccacagtacagctggctccttccccacccaaatcccccaaagtcctttactcacccatctcaccactttcaccaggcaaagccttagaatcagcctttgtaccttatgaaaaacccctccctgatgatataagtccacagaaagtactgcatccagatatggctaaagttcccccagcaagtcctaagacagccaagatgatgcagcgttctatgtctgaccccaagcctctgagtccaacagcagacgaaagttccagggctccttttcagtataccgagggctatacgactaaaggttctcaaaccatgacatcctctggagcccagaaaaaagttaaaagaactctgccaaatccacctcctgaggagatttccacaggaactcaatccacattcagcacaatgggcacagtttccaggagaaggatctgcagaaccaacacaatggcacgagccaagattctccaggacatagacagagagcttgatcttgtggaaagggagtctgcaaaacttcgaaagaaacaagcagagcttgatgaagaagaaaaggagattgatgctaagctacgatacctggaaatgggaattaacaggaggaaagaggccctattaaaggagagagaaaagagagaacgagcctacctccagggagtagctgaggatcgtgattacatgtctgacagtgaagtgagtagcacaagaccaacccgaatagaaagtcagcatggcattgagcgaccaagaactgctccccaaactgaattcagccagtttataccaccacaaacccaaacagaatctcaactagttcctccgacaagtccttacacacaataccagtactcttcccctgctcttcctacccaagcacccacctcatacactcaacagtctcattttgagcaacaaactttgtaccatcagcaagtttcaccttatcagactcagccaacattccaagctgtggcaacaatgtccttcacacctcaagttcaacctacaccaaccccacagccttcttatcagttaccttcacagatgatggtgatacaacagaagccacggcaaactacattatatttggagcccaagataacctcaaactatgaagtgattcgcaaccaaccccttatgatagcacctgtttctacggataacacatttgctgtttcccatcttggtagtaagtacaatagtttagacttgagaataggtttggaggaaagaagtagcatggcaagcagtccaatatcaagcatatctgcagattctttctatgcagatattgatcaccatactccacgaaattatgtcctaattgacgacattggagagatcaccaaaggaacagcggcattaagcaccgcatttagccttcatgaaaaggatctgtcaaaaacagaccgtctccttcgaaccactgagacacgccggtctcaagaagtgacagatttcctagcacctttacagtcttcctctagattgcatagttatgtgaaggcggaggaagacccaatggaggatccttacgagttaaagcttctgaaacatcagattaaacaggaatttcgtagagggacagagagcttagatcaccttgctggtctttctcattattaccatgctgatactagctacagacattttccaaaatctgagaagtatagcatcagtagactcacacttgaaaaacaagcagcaaaacaactgccagcagccatactttatcaaaagcagtcaaagcataagaaatcactaattgaccctaaaatgtcaaaattttcacctattcaagaaagtagagaccttgaacctgattattcaagctatatgacttctagcacttcatctattggtggcatttcctccagggcaaggctccttcaagatgacatcacttttggcctcagaaaaaatattacagaccaacaaaaatttatgggatcttctcttggcacaggactgggcacattaggaaataccatacgctcagctctgcaggatgaagcggataagccatacagtagtggcagcaggtccagaccttcctccagaccttcctctgtctatgggcttgatttatcaattaaaagggattcttctagctcttccctaagactgaaagctcaagaggctgaagctctagatgtttcctttagtcatgcatcatcctctgccagaactaagccgaccagtttgccaattagtcaaagtagaggaagaataccaattgtggcccagaattctgaagaagaaagcccactcagtcctgttggccagccaatgggaatggccagggctgcagctggacccctgccaccaatatctgcagacaccagggatcagtttggatcaagccactcattgcctgaagttcagcaacacatgagggaagaatcacggactcgaggctatgaccgtgacatagcattcatcatggatgacttccaacatgccatgtcagacagtgaagcctatcatctgcgtcgtgaggaaacagattggtttgataaacccagggagtctcgtttggaaaatggacatggtctggaccgaaaactgccggaaagattggtccactctagaccactcagtcaacatcaagagcaaattatacagatgaacgggaaaactatgcactacatctttcctcacgcaaggataaaaataacaagagactcaaaggatcacacagtttcaggtaatggattaggaattagaattgtgggtggtaaagaaatcccgggacatagtggagaaattggagcctatattgccaagattcttcctgggggaagtgcggaacagacggggaagcttatggaagggatgcaagtattggaatggaatggaattcccttgacttctaaaacatatgaagaagttcagagtatcattagtcagcaaagtggggaagcagaaatatgtgtaagactggacctcaatatgctatcagattctgaaaattcccagcatctggaacttcatgagccaccaaaagctgtggataaggcgaaatccccaggggttgatcctaagcagttggcagcagaactccagaaggtttcactacagcagtcaccgctggttctgtcatcagttgttgaaaaaggatctcatgttcattcaggtcctacatcagcaggatccagttccgttcccagccctgggcaaccagggtccccctcagtgagcaaaaagaagcacggcagcagcaagcctaccgatggaacaaaggttgtctctcatccaattacaggagaaattcagcttcaaattaactatgatcttggaaatctcataatacatattctccaagcaagaaatcttgttcctcgagacaacaatggttattctgacccttttgtgaaagtgtaccttcttccagggagaggtcaagtcatggttgtccagaatgcaagtgctgagtacaagagaaggactaaacatgtccagaaaagtcttaatcctgagtggaatcaaacagtaatttataaaagtatttccatggaacagctcaagaagaaaacactggaggtgacagtttgggattatgatagattttcatccaacgacttccttggggaggtattgattgatttatctagcacatctcacctcgataacactccaaggtggtatcctctcaaagaacagactgaaagcattgatcatggcaagtctcattccagtcagagcagccagcagtccccaaagccatctgttatcaaaagcagaagccatggtatcttccctgacccatcaaaggacatgcaggttcccaccattgagaaatcccatagtagtcctggtagctcaaaatcatcatcagaaggccatctccgttctcatggaccatctcgcagtcaaagcaaaaccagcgtcactcagacccacctggaagatgcaggggctgccatagctgctgccgaagctgccgtgcaacaactccgcattcaaccaacaaagcctcccaatcaccggcctgcagaaagctctgtgtccaccggctcctcgggcagcagctttggcagtgggtatagcgtggacagtgaaggaagcagcagcactgcaggggagactaatctatttcctattccgaggatagggaagatgggacagaatggacaagagcctgtaaaacagccaggggtaggagtaggactagcagacactgaagctaaaactcaggtaatgggagaaatcaagattgcattgaagaaggaaatgaagacagatggtgaacaactaatagttgaaattctccaatgcagaaatattacatacaaatttaagtctcctgatcatctaccagatttatatgtgaaaatatatgtgatgaatatttctacccaaaaaaaggtgatcaagaaaaaaacaagagtatgcagacatgatcgagagccttcgtttaatgaaacttttcgattcagtctaagtcctgcaggacattctcttcagattttacttttctccaatggagggaagtttatgaaaaagaccttgattggtgaagcctgtatctggcttgacaaagtggatctcagaaaaagaatagtcaactggcacaaacttttggtcagtcctactcaaacgcattgaagaaacatgtcttctcagggtatagaaactgctctaaatagcctcacatcaagactatagttgaatactattgtacaaagctaagttttgagaggcaaacataagagtgggaacaacaagcaaaaacatacttaagaccttgtacatttattgttgtggatcacacaaagatattcaactgaaaaagttcacatactgaaaacaagaagaatggagttctgagaccttgaatttcccatggctgtgaagagaaactgtgaaacaaattttgattacttaagacaataatctttgagtagagttgagctatagcttaagacaggctcaaagattaatgtggttttcatgcagcacaaaggtaattctttatgcaaaggagccttggttgaaaggaaaggactgatgtaacaaatctcagttttcaaaacttcaaaaatcttccttcatcgtcttctattcagacaacttgctgctttcagattctgacataagatatacctacagtatgtgtccagggctggaagtgaggtggctgtgttcttagggaaaatggaagaggagatgtagaaattgtggctttcaggccatattttaccagttttctctgtgtctaaatgttacaagcatatacaacactgactttggaatccatgtggtaaaagcacatttgtttctgtatcatttgaaacaaggtagagtgaagataatactcagtagaaataaaattgaatttatctagaaataaaactatgactggctaacaaagaagaatgttgccccataaaatattggaattttggttgaaaccatcaaaatcttcataatttaccattaagccaagacatcttcagtctatgtaccaaaggacctagagtaaactgatatgttctaggaagcatgataacttactctttgtgaaactgcaaataaatgtattatcctgcacatttcctttctgttgagcgatgcattgacagagaaagaaaattctttctctggcaaacaaaccatattaatcttgtgacattgattaattaaatggatcctcatttcataatattttatgcttttttccttaatgacttaattcatttactgattgtatcatgaaaacatgacactaaactcgagttctctctagtgctctattttcttactttagtgacagtatcacagtgatcaagttcatcaatgttgggaaaatatgtgaaaagtcaacatttacctgagattaaaatatactttgagctattttaataataatgaataaaacaactaatgtccaagtcttaaaatgaagcaccctcttctctatcagcattattaattaaggaagtaacgtgaagttgtggaaaaaacactcagcagggaataaaagcctgtcttctggtcttagttctaccactgactgtgtcactttgcacatgtcacttacactcactttaccccagttttcttatctataggataaaaacaattatatattcttaaccttccaaatgagatgttgtgatgataaatcaatgatccatgaaagatgaaagcacatttccaaatatagttttatacacagaagtgaggaataattattacatatctttttaattctcaaattttatatgtgaaaaacatcatctaaaccaatggcaaggattgacatggataaaagcagtaaattagccacaaaacttattttttatttaaaatataaactttaacctgactaaaggtgaagaattacatgaaaatgcaaattttgctatcccaaattaaatgaataatgctggtcttaccctagtcctatattccacccaaaagaaataaatcaaattgcttctcagagcattctgagcttaaaacctgctgctttatttaagggtgaagtgttagtggaattagagaaaaccaactctagatattggttggatattgaattttctcatttttaaagaaaaaatgctctaaatttgagaggactgtaaagcactaaaaataagagaatttctaatatatcccaggatatatatatatatatatgacttcagaatacaaattcgatcttccccaaactgagaaagataaccataacttttcttccctctattttttaatccccctccactgacaatacaatgtcatttaccattgacattgctctcaaatgagcatgggagagtggaatcatcaaagacattatattgctagtattttatttttagaaactattagatctgctgatggttgccatggatatttccagcagaagctagcacttgaagaagcctataatcatcactcataattggggaagaaaaggtccaaggagatctccttctgacataaaaaggctctggtatttgcccttaaaagaaaaccctgactcatctctgatcctcttttgcagccactcatatccataggtatgcatgagagtttgtatgaccagttagctttcttcattccagttgcaatttcttttagaataatataaatggagggatcaccaaaacaaagattatctctttggtagctatttaacctgaaagcgtaggagtctttccattatagaagcccctccgttccaaggaactagcgatggggctaggtcaatcagcagagttgacaacagggcttctttttgtgcaccagcattccccttcagagagcataagatcctgccagtgtgccaagtttgcagctgaccaaacttctaggttgtactggaattattctatgcaacactgatccttatatgaatgcgtttcttctgaatgatgttgactacccttcttacaacaaaactgtttcttttttattgcaaatagggctcttggtgttttttacttttttgtacatatcacagtacatggtttttcactctttagtttatttcattttattggaattaacttttttttattctaatactgacagagtttgtaatctctatataatacgtaattactccaattacagcacttttaccttgaagagcatctcagtttttcccacaatttcattgagtcatcagagactgatgttgcttcttggtttcaaatttggtcctaaagaaactttcggctgtagaaacaaaagcacagagtgaattttttacaaaagacagggaatatagaatagtcattacagacacaaataaccctagtagcacgaagttggtgttttctctgtttttacttaagattaagaagatttttggtgactctgaactctttatttatatttcagtttaaaatatcaagactaaggggcatcagttatctttactctttaatattgcccatattttaataaattacactaattaaacgcatattttcagcataccagtggaattaattttgtggatcacacacatttaaatagtcatattgtgggaatattatagctggtaaccagctgatattgattcttattataggaatgactgtaatgatagtggtggtagcagtagtgatattagcggtggtggtgatgtgaagtaaaataaaagtatatattatattgtgcccaatttattagaaattatttgatcaatgcttcatttcattaaaatatcataaagatgtttatagtatttttttactttattatttaaatcataactaacaatatttttaaaaacttattttcattgctacaatgtcaaatattccaaaatcagccaactacagctatatatgtgttatgtgtgacagaagtgatcttccttccctctttttgagcttgacatgaaagtgaaagaagactcaatgaataattatgagctatttatttaataattacttgccttgggtgtaatacagtaatgaatgagtgaaacaaatattctcattgaatatgatacaatgctgttttctgtatgtttcatgttctattattaaaggtatccattaggccaaaattatttaatcaaattctttatctgataggtagattgagagcattttcttaatgcattaccttgtacataagtatacacttggtaaagtagacgaagttgaaatattaatttcatttggcatttagcatgtgaatatgattattgtttgattgtgtctgtatatttgtttggtgacgtgctcaggtgctcccactactgattaatgtgtgtgctaatatcctaaaaacacatatgaggtttaagaaaaaattttcttgtctgaaaacataaacatcttaataaaactgattttgaaataaaaactaaagtacttgaagatatgtcttgtttctaactatatgttgcatgccatgttggtgatttgctaatgtgtttttttgtttgtttgttttacccaaatccctttggaaaatctaatggacaaatgcaaattcttggactaaggactgtataaattgacctgaaaatacatgagagttgcatttaaaaaaaaatgcttgtaaatccgtcttgagttttactctatgtaaaaatatgtcttggttttgtgattgtatacaagatgtatcttgataacttatgtaaactgtgccgtataaaggctgttgcctcagccttactaataaatactgaaaatatcacctttga

SEQ ID NO: 22613 - DNA, 2482 bp, Homo sapiens
atgttaacaattaatcagttcaagttggtcatcttcctagataacctggaccgtaatcttcctagataacctggacatcaggattggtgatggggctgaggggccagtgagtgtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctc

SEQ ID NO: 22614 - DNA, 9712 bp, Homo sapiens
gccccgggagcgtgccctcggggcggagagcgtcgcggcccgcgccgaggcgatgctcgggtggctgcgagctgccggcggcgagaggccatagacgggcatgggccttgcgtcccaccacccctagggaccctcgagcctcgcccctctgctccgactcgccggaccgacgcgatggcctcagaagtggtgtgcgggctcatcttcaggctgctgctgcccatctgcctggcagtagcatgtgcattccgatacaatgggctctcctttgtctaccttatctacctcttgctcattcctctgttctcagaaccaacaaaaacgacgatgcaaggacatacgggacggttattaaagtctctgtgcttcatcagtctttccttcctgttgctgcacatcattttccacatcacgttggtgagccttgaagctcaacatcgtattgcacctggctacaactgctcaacatgggaaaagacattccggcagatcggctttgaaagcttaaagggagctgatgctggcaatgggatcagagtgtttgtacctgacatcgggatgttcattgctagtctgaccatctggctcctctgtagaaacattgttcagaaacctgtgacagacgaagcagcacagagtaacccggagtttgaaaatgaagaattggctgaaggagaaaaaattgattcagaagaggcactgatctatgaagaggatttcaatggaggagatggtgttgaaggcgagttggaagaaagcacgaagttaaaaatgttccgcaggcttgcctctgtggcctctaagctcaaggagttcattggcaacatgatcaccactgctgggaaagtcgttgttaccatcttactgggctcctcgggcatgatgttgccgtctttgacatcatctgtgtatttttttgtatttttgggtctgtgcacctggtggtcctggtgccggacgttcgacccattgctgttcagctgtctctgtgttctgctggctattttcactgctggacatttgattggactttatttataccagttccaattctttcaagaggcagttccacccaatgactactatgcaaggttgtttggtatcaagtcagtaattcaaacggactgttcaagtacttggaagatcatagtgaacccggacctgtcgtggtaccaccacgccaaccctatcctcctgctggtgatgtactacactctggccactctgatccgcatctggctgcaagagccccttgtgcaggatgaggggaccaaagaagaggacaaagccctggcttgtagccccatccaaataacagcggggaggaggcggagcctgtggtacgcaacccattaccccactgatgagagaaaacttttatccatgacccaggatgactacaaaccatctgatggcctgctggtgactgtgaacggcaaccccgtggattaccacaccatccacccaagcctgcccatggagaacggccctggcaaagccgacctctactccacccctcagtaccggtgggagccctctgatgaatcctcagaaaagcgagaggaggaagaggaagagaaagaagaatttgaagaagaaaggagccgtgaggaaaaaagaagtatcaaagttcatgccatggtctccgtattccaatttattatgaaacaaagttacatctgtgccctcatagctatgatggcctggagcatcacctatcacagctggctgaccttcgtgctgctgatctggtcgtgcactctttggatgattcgcaacagaagaaaatatgccatgatcagctctcccttcatggtggtttatggaaacctattgttgatattacagtatatatggagttttgaacttcctgaaattaaaaaagttccaggatttttagaaaagaaagagccaggagaacttgcttccaaaatccttttcaccattactttttggctactgctgaggcagcacctcacagagcaaaaagctctgcaagaaaaggaagctcttttatcggaagtcaaaattggcagtcaggaaaatgaagaaaaagatgaggaacttcaagatatacaagtggaaggagagcccaaagaggaggaagaagaggaagcgaaggaagagaagcaagagagaaagaaggtagagcaagaggaagctgaagaagaagatgagcaggacatcatgaaagtcctgggcaatctggtggtggccatgttcatcaagtactggatctacgtctgcggaggcatgttcttcttcgtcagcttcgagggtaaaatcgtaatgtacaaaatcatctacatggtgctgttcctgttctgtgtggccctataccaggtgcactatgaatggtggaggaaaattctaaaatatttttggatgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgacaaagacacaaagagaaaaaaaggtctgcaagagaagaacggaaacgaaggcggaaaggatccaaggagggtcctgtggaatgggaagaccgggaggatgaaccaatcaaaaagaaatccgatggaccagataatatcatcaagaggatatttaatattttgaaatttacctgggtcctatttctggcaacagtggacagtttcactacttggcttaactccatttcaagggagcatattgatatatctacagttctgagaattgaacgatgcatgctgaccagagaaattaagaagggcaatgttccaactcgggagagcatccacatgtactatcagaaccacatcatgaacctttccagagagtcgggactggacaccattgacgagcatcccggagctgcttcaggtgcacagacagcccacaggatggatagtttagattcacatgacagtatctccagcgagcccacgcagtgtaccatgctgtactcacgccaggggaccactgagaccatcgaggaggtggaggctgagcaggaggaggaggcagggagcacggcgcctgagcccagggaggccaaggagtacgaggccactgggtacgatgtgggagccatgggtgccgaggaggccagcctcaccccagaggaagagctgacacagttctccaccttggacggggatgtggaggccccaccctcctacagcaaggctgtgagcttcgagcatctgtccttcggctcgcaggacgactctgcaggcaagaaccgtatggcagtcagcccggacgacagccgcaccgacaagctggggtccagcatcttacctcccctgacccatgagctgacggccagcgagctgctgctgaaaaagatgtttcacgacgatgagcttgaagagtcagagaaattctacgtggggcagccccgatttctgctgctcttctatgccatgtacaataccctggtggcccgctcggagatggtgtgctacttcgtgatcatcctcaaccacatggtctctgcctccatgatcacgctcctgcttcccatcctcatcttcctctgggccatgttgtccgtccccaggcccagccgccggttctggatgatggccatcgtctatactgaggtggcaattgtagtcaagtatttcttccaatttgggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaagtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagtgatactcttactgccttatcttaaccaaggactaataggatacctttccattaaacaccagtgacttctcaggaaaaaaaaaaaaaaggagcaaaacaaatgatgtgtacacctgctttgttatggtccaccagtgaccagcttcaatgaggggaaccattctggagggctgcggtctcctgtgcaaacagacatgaggcagaagagtaaaaagaccaacccagtgggacctagaatactttgtaactctttaataactgaggtcaggaccgctcttctgccttccccttcccttaacgtgctttttcccatttccatgatttaaggcaatggtttttccagtatgtgacattttccttcctgtttttcaggtatatcaaagagtttacatattccaattcacatttttacatctgagacgggttttttaagttcataattatgaaagaaatatgtatattgagcttggggaaataaaaatggccttttcttaaattattattattggtaatacaacctcttcattaaataacaatgtagcatgaaaaatttatgattgaaatgtagttttcattccatattaagatacagtttctgagaagaatcattgaatggactagaatatgtcaaaaattgatcctgtgtagtttgggttcagggctgacttaaaataaagcacatcctgcaaagtc

SEQ ID NO: 22615 - DNA, 2650 bp, Homo sapiens
atgtcagtggttatttacactatgctggtgcttatctttatatacacatatcagtttgagaacttcccaggcctgtggcaaaatatgactggactgaaaaaagaaaagcttgaggatcttggcttaaagcagtttactgtggctgaactattcactcgcatattcatcccaacctcctttctgctggtgtgcattttacacctgcactacttccatgaccggttccttgaactcacagacctcaagtccattcccagcaaagaagacaacaccatctacagccatgccaaagtcaatggtcgcgtatatctaataataaatagcatcaagaaaaaattaccaatccaccaaaatgaactggcccacccggaaggaagcctcccggacctcaccatgatgcatctgactgccagcctggagaagccggaggtgaggaagttggctgagcctggggaggagaagcttgagggctactctgaaaaagcccagaagggtgatcttgggaaagacagcgaggagtcagaggaggacggagaggaagaggaggaatccgaggaggaggaagaaacatcagacttaaggaacaaatggcacctggtgattgaccgcctcactgtgctcttcttaaaattcctggagtattttcacaagctgcaggtgttcatgtggtggattttggagttgcacatcatcaaaatcgtttcctcttacattatctgggtttctgtgaaagaggtgtctctgttcaactatgtatttttgatttcttgggcttttgctctgccgtacgccaagctgcgccgtctggcttcaagtgtctgcacagtctggacgtgtgtgatcatcgtctgcaaaatgttgtaccagctccaaaccattaagcctgagaacttctctgttaactgttccttgccaaatgaaaatcaaacaaacatcccctttaatgagttgaacaagtctctgctctacagcgctcctatcgatcctacagagtgggtcggcctgcggaagtcttcgcctctgctagtctacctgaggaataacctcctgatgctggctatcctggcctttgaagtcaccatttaccgccatcaggaatactatcgaggtcgaaataacctgacggcccctgtgtctagaactatctttcatgacattacaagactacatctagatgatggacttattaattgtgccaaatatttcattaattacttcttttacaagtttggtctggagacctgtttcctaatgtcagttaacgtcattggccagcgaatggatttctatgccatgatccacgcctgctggctgatcgctgtcttatatagacgcagaaggaaagccatcgcagagatctggcccaagtactgctgcttcctggcatgcatcatcaccttccagtatttcatctgcattggcatcccacctgctccttgccgagattacccgtggagattcaagggtgccagcttcaatgacaacatcataaagtggctgtacttcccagatttcattgtgcggcccaaccctgtgtttctcgtctatgacttcatgctgcttctgtgtgcctccttacaacggcagatttttgaggatgagaacaaggctgcagtgcgaatcatggcaggtgacaatgtcgagatctgcatgaaccttgatgcggcctccttcagccaacataaccctgtgccagattttattcactgcagatcttacttagacatgtccaaagtgatcatcttcagctacctcttctggtttgtgctcaccatcatcttcatcactgggaccaccaggatcagcatcttttgcatggggtacctggtggcctgtttctacttcctgctctttgggggcgatttgctgttgaaacccatcaagagcatcctgcgctactgggactggctgatcgcatacaacgtttttgtgattacgatgaaaaatatcctgtcaataggagcatgtggatacattggaacattggtgcacaatagttgttggttgatccaggctttcagcctggcctgcacagtcaaaggctatcaaatgcctgctgctaattcaccctgtacacttcccagtggggaagcaggaatcatttgggacagcatatgttttgccttcctcctgctgcaaagaagagttttcatgagttattattttctacatgttgtggctgatataaaagcttcccagattctggcatcaagaggagctgaacttttccaggccacaattgtaaaagctgtaaaggcaagaattgaggaagagaagaagtccatggaccagctgaagcgacagatggatcgcatcaaggccaggcaacagaaatataaaaagggtaaggagaggatgctgagcttgacccaggagccaggggaaggccaggacatgcaaaaactctctgaagaggatgatgaaagagaagcagacaaacagaaagccaagggcaaaaaaaagcagtggtggcggccttgggttgatcatgcttccatggtcaggagtggagattattatttgtttgaaacggatagtgaagaggaggaagaggaagaattaaagaaggaagatgaagaacctccacgaaggtcagcattccagtttgtttatcaagcctggattactgatcctaaaacagcactccgac

SEQ ID NO: 22616 - DNA, 3524 bp, Homo sapiens
gggttctttccctggaataagaatgtggaggtgaacaaagataaaccgtatcaccccccaaacatcataggagtggaaaagaaggaaggttatgttctctatgacctcatccagctcctggctctgttctttcatcgatcaattttgaaggtactgcatgttaacaattaatcagttcaagttggtcatcttcctagataacctggaccgtaatcttcctagataacctggacatcaggattggtgatggggctgaggggccagtgagtgtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctccatccccactggggaagctgctgtgatgagactagatgagccttcaacacactcagaaaatgcaacagcaatagggggcagacagctcctacctgtgtttctaggagcaaaagagagggaactaattgcccgtgaagacgccagtggaaggatcagcctcattctaagcaaaaacatagtattagtgatactcttactgccttatcttaaccaaggactaataggatacctttccattaaacaccagtgacttctcaggaaaaaaaaaaaaaaggagcaaaacaaatgatgtgtacacctgctttgttatggtccaccagtgaccagcttcaatgaggggaaccattctggagggctgcggtctcctgtgcaaacagacatgaggcagaagagtaaaaagaccaacccagtgggacctagaatactttgtaactctttaataactgaggtcaggaccgctcttctgccttccccttcccttaacgtgctttttcccatttccatgatttaaggcaatggtttttccagtatgtgacattttccttcctgtttttcaggtatatcaaagagtttacatattccaattcacatttttacatctgagacgggttttttaagttcataattatgaaagaaatatgtatattgagcttggggaaataaaaatggccttttcttaaattattattattggtaatacaacctcttcattaaataacaatgtagcatgaaaaatttatgattgaaatgtagttttcattccatattaagatacagtttctgagaagaatcattgaatggactagaatatgtcaaaaattgatcctgtgtagtttgggttcagggctgacttaaaataaagcacatcctgcaaagtcattttaa

SEQ ID NO: 22617 - DNA, 2671 bp, Homo sapiens
atgttaacaattaatcagttcaagttggtcatcttcctagataacctggaccgtaatcttcctagataacctggacatcaggattggtgatggggctgaggggccagtgagtgtgccatggcttatgggatgaagatgacatgactgaaagtggcatggccagggaggaatcagatgatgagctctccctcggtcatggcaggagggactcctccgattctctcaagtccatcaacctggccgcgtctgtggagtcagtgcatgtgaccttcccggagcagcagacagctgtccggaggaagcgctccggcagcagctccgagccatcccagagatccagcttttcttcaaacagatcccaaagaggcagcacaagcacccgaaacagcagtcaaaaaggaagcagtgttttgagtattaagcaaaaaggcaaaagggaactttatatggaaaagcttcaagaacatttaatcaaagcaaaagcctttaccataaagaagacgctggagatctatgtgcccatcaaacagttcttttacaacctcatccacccggagtatagcgccgtgactgacgtgtatgtactcatgttcctggctgacactgtggacttcatcatcattgtcttcggcttttgggcctttgggaaacactcagcagctgcagacatcacctcttcactgtcagaggaccaggtcccggggccgtttttggtgatggtcctcattcagtttggaaccatggtggtggaccgagccctctacctcaggaagactgtactgggaaaggtcatcttccaggtcattcttgtgttcggaattcacttctggatgttcttcatcttacctggtgtgactgagaggaaattcagccagaacctggttgcccagctttggtactttgtgaaatgtgtttacttcgggttgtctgcttaccagatccgttgtggctacccaacgcgagtcctggggaacttcctcaccaagagctacaattacgtcaacctcttcttattccaagggtttcgcctcgtgccctttttgactgagctgagggcagtgatggactgggtgtggacggacacaactttgagcctgtccagctggatctgtgtggaggacatctatgctcacatattcatcctgaagtgttggcgggagtcggagaagagataccctcagccacggggccagaagaagaagaaagtggtgaagtatggcatgggaggaatgatcatcgtcctgctcatctgcattgtctggtttcctcttctcttcatgtctttgatcaaatctgtggctggggtcatcaaccagcccctggacgtctccgtcacaattaccctgggagggtatcagcctattttcacaatgagtgcccaacaaagccagttgaaagttatggaccagcagagctttaacaaatttatacaagctttttctagggacaccggtgctatgcaatttctggaaaattatgaaaaagaagacataacagtagcagaactggaaggaaactcaaattctttgtggaccatcagcccacccagtaagcagaaaatgatacacgaactcctggaccccaatagtagcttctctgttgttttttcatggagtattcagagaaacttaagtctgggtgcaaaatcggaaatagcaacagataagctttcttttcctcttaaaaatattactcgaaagaatatcgctaaaatgatagcaggcaacagcacagaaagttcaaaaacaccagtgaccatagaaaagatttatccatattatgtgaaagcacctagtgattctaactcaaaacctataaagcaacttttatctgaaaataatttcatggatattaccatcattttgtccagagacaatacaactaaatataacagtgagtggtgggttctcaacctgactggaaacagaatatacaatccgaactctcaggccctggaactggtggtcttcaatgacaaagtcagtcccccaagtctggggttcctggctggctatggtattatgggattatatgcttcagttgtccttgtgattgggaaatttgtccgtgaattcttcagtgggatttctcactccatcatgtttgaagagcttccaaatgtggatcgaattttgaagttgtgcacagatatttttttagttcgagagacaggagaactggagctagaagaagatctctatgccaaattaatattcctatatcgctcaccagagacaatgatcaaatggactagagaaaaaacaaattgaaaccttagaacacagactgcaaataatgttaacatttgaattttttttaaaagcacaatattctcataagagctaagcatttctagttcgacggaaatggtttgtttctcttctgataggtagacaaaaggagctgatatccttctgcagtaaaagctaccttgcaagttaaggcactgttgaaaatgttatttgtaactccatttctctgaaatcagggctacttgctttatgttttagtcaacagtgtctcgcattctgattgatcatgtgaaggaatcatttatgggccccgtccctaagagaaacagaagaggagtcagaaagaaagatgcctgtgttttcctctgtggggcccgtgcacttcctggagagatgctacaatgcaatatacagcgctc

SEQ ID NO: 22618 - DNA, 3251 bp, Homo sapiens
cgagggcgaggcggccacgcggggccgggaatgcccgcggtgcggggccccagagccgcccggtggtcgtgtccgggcgatggctcttcgcctggtcgccgacttcgacctcgggaaggacgtgctcccgtggttgcgggcgcagcgggcagtgtcggaggccagcggggccggaagcggcggcgcagatgttttagaaaacgattatgagagcttacatgtattaaatgttgaaagaaatggaaatattatttatacctataaggatgataagggaaatgtcgtctttggattatatgattgtcaaaccagacaaaatgagcttctatatacctttgagaaagacttgcaagttttcagttgctctgtcaacagtgaaaggactttgcttgctgcaagtttagttcagtctactaaagaaggaaaaaggaacgaacttcaaccaggatcaaagtgcttgactttgttggttgaaatccaccctgttaacaatgtgaaggttctaaaggctgtggatagctatatttgggttcagtttctctacccacatattgaaagtcatcctcttccagagaaccatctgttactgatttcagaagagaaatatattgaacaatttcgtatccatgtcgcccaagaagatggaaatagagtggtgattaaaaattctggccatctcccaagagacagaatagctgaggatttcgtttgggctcagtgggatatgtcagaacagagattatattacattgacctgaagaaatcaaggagtatcttaaaatgtatccagttttatgctgatgagagctataacttaatgtttgaagtacccttggacatatcattaagcaactcaggatttaaacttgtcaactttggatgtgattatcatcaataccgagataaattttccaaacacctgactctgtgtgtttttaccaaccatacaggaagtttgtgtgtatgttacagcccgaagtgtgcctcttggggacaaatcacatattcagtgttttacattcataaaggacacagcaagaccttcaccacttctcttgagaatgttgggtcacacatgacaaagggcattacttttctcaaccttgactattatgtggctgtttacttacctggtcatttcttccacctacttaatgttcaacatccagacctgatctgccacaatctctttctgacaggaaataatgaaatgattgatatgctacctcattgccctttacagtcattgtcagggtccctggtattggattgttgttctggaaagctctatagagcactgctcagccagtcgtctttattacagcttctgcagaacacttgcttagactgtgagaagatggctgcgttgcactgcgcgctctactgcggtcaaggtgcgcagttcctggaagcccagattattcagtggatttctgagaatgtctctgcctgccattcatttgacctcattcaggaatttataattgcttcttcatactggagtgtatattcagagacaagtaacatggacaaactattgccacattcctcagtgctcacttggaatacagaaattcctggaataactcttgtgacagaagacattgcattgcctcttatgaaggtgctcagctttaagggctactgggaaaaactgaactccaacctagaatatgttaagtacgccaagccacacttccactataacaacagtgtggtcaggagagagtggcacaacctgatctctgaagagaaaacaggaaaaagaaggtctgcggcatacgtgaggaatattcttgataatgcagtaaaggtgatttctaacctagaagcaagaaatttggggccaagattaacacccctcctgcaggaggaagacagccaccagcggctgctcatggggctgatggtgtctgagctaaaagaccattttttgagacacctacagggtgtagaaaagaagaaaattgaacagatggttctggactacatttcaaaactgctggatctcatttgccacatcgtagaaaccaattggaggaaacataatcttcattcctgggttctccacttcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattttaatcttgctcattaaccttactcctttgagaattctttaacaatatttaaaattggtaacaaaaatagtttagccataattgtttagccatgtgagtttcaggttggtacacgttcagacagaactgctgtatcacattccaattttgaatagccagtgagcaatcaagtgtagagaaatgataaatggcctaagaaggcatacagtggcataaacgatgctcttcctagtagcttaataggccacaagctagtttctgttgcactctgaaataaaatatgctttaaaaatgtagggaacagtgcttagaaaagcaaaaactaggtgtgtcattgaaataataggcataaaaattaaatgttacataagaacactatttggaaagagggtccttttaaaaactgaatttgtactaaatcagatttgccatgtccagtacagaataatttgtacttagtatttgcagcagggtttgtctttgtgaattcagatgaaacatatttatttttttttatttataaaaggttgatttaggaatattttgtcagtcattaaaaaacctgaaaacata

SEQ ID NO: 22619 - DNA, 737 bp, Homo sapiens
aggaagacagccaccagcggctgctcatggggctgatggtgtctgagctaaaagaccattttttgagacacctacagggtgtagaaaagaagaaaattgaacagatggttctggactacatttcaaaactgcaatagtcgtggcagtgctgctgaatttgcagtttttcacatcatgaccaggattctggaagctacaaacagtttgtttttacctctgcctcctggttttcatactctgcacaccatcctcggggtccagtgtctccctttgcataacctgctgcattgcattgacagtggagtgttgcttctcactgaaacagctgtcataaggctcatgaaagatctggataatacagagaaaaatgaaaaactgaaattcagtatcattgtgcggcttcctccgcttattgggcagaagatttgtagactttgggatcatcctatgagttctaacatcatttcgcggaaccacgtgacgcgactgcttcagaactataagaaacagcctcggaattctatgattaacaagtcatcgttcagtgtagaatttctgcctctgaactacttcattgaaattctgacagatatagagtcctccaatcaagccctgtatccttttgaaggacatgacaatgtggatgcagaatttgtagaggaagcagctctgaaacacaccgcgatgcttttaggcttatgaaaaagaaaacgcaattggatctgctgctgccattt

SEQ ID NO: 22620 - DNA, 1246 bp, Homo sapiens
atactccagtcctgtgtttaccgatagaccggaagtgtggcttcgtttacagttcggcacgtaggacggagggtagtgcgtctagagacacatattccccacggatttgacgatggtgttcggtcttgaatggaaatgtagtcttaggccagtcttaggtttttgaacaggatagtaggtatccggagtcgattgagggccagagcaggcactggggttcggatcctgggcaaagtttcccacgttgagggtctcgaggacgcctagatctctttcccagggccatggcgaacccgaagctgctgggaatggggctaagcgaggcggaggcgatcggtgctgattcggcgcgatttgaggagctgctgctgcaggcctcgaaggagctccagcaagcccagacaaccagaccagaatcgacacaaatccagcctcagcctggtttctgcataaagaccaactcctcggaagggaaggttttcatcaacatctgccactccccctctatccctcctcccgccgacgtgaccgaggaggagctgcttcagatgctagaggaggaccaagctgggtttcgcatccccatgagtctgggagagcctcatgcagaactggatgcaaaaggccagggatgtaccgcctacgacgtagctgtcaacagcgacttctaccggaggatgcagaacagcgatttcttgcgggagctcgtgatcaccatcgccagggagggccttgaggacaaatacaacttgcagctgaatccggaatggcgcatgatgaagaaccggccattcatgggctccatctcgcagcagaacatccgctcggagcagcgtcctcggatccaggagctgggggacctgtacacgcccgcccccgggagagctgagtcagggcctgaaaagcctcacctgaacctgtggctggaagcccccgacctcctcttggccgaagttgacctccccaaactggatggagccctggggctgtcgctggagatcggggagaaccgcctggtgatggggggcccccagcagctgtatcatctagacgcttatatcccgctgcagatcaactctcatgagagcaaggcagccttccaccggaagagaaagcaattaatggtggccatgccgcttctgccggtgccttcttgatcagggtgtctccttgtgcttctgagatgtggagaagaggctgctggcttccctaaaagttgaaataaaagatttttgcctttgttctg

SEQ ID NO: 22621 - DNA, 2650 bp, Homo sapiens
gaggaggcccgagaggagtcggtggcagcggcggcggcgggaccggcagcagcagcagcagcagcagcagcagcaaccactagcctcctgccccgcggcgctgccgcacgagccccacgagccgctcaccccgccgttctcagcgctgcccgaccccgctggcgcgccctcccgccgccagtcccggcagcgccctcagttgtcctccgactcgccctcggccttccgcgccagccgcagccacagccgcaacgccacccgcagccacagccacagccacagccccaggcatagccttcggcacagccccggctccggctcctgcggcagctcctctgggcaccgtccctgcgccgacatcctggaggttgggatgctcttgtccaaaatcaactcgcttgcccacctgcgcgccgcgccctgcaacgacctgcacgccaccaagctggcgcccggcaaggagaaggagcccctggagtcgcagtaccaggtgggcccgctactgggcagcggcggcttcggctcggtctactcaggcatccgcgtctccgacaacttgccggtggccatcaaacacgtggagaaggaccggatttccgactggggagagctgcctaatggcactcgagtgcccatggaagtggtcctgctgaagaaggtgagctcgggtttctccggcgtcattaggctcctggactggttcgagaggcccgacagtttcgtcctgatcctggagaggcccgagccggtgcaagatctcttcgacttcatcacggaaaggggagccctgcaagaggagctggcccgcagcttcttctggcaggtgctggaggccgtgcggcactgccacaactgcggggtgctccaccgcgacatcaaggacgaaaacatccttatcgacctcaatcgcggcgagctcaagctcatcgacttcgggtcgggggcgctgctcaaggacaccgtctacacggacttcgatgggacccgagtgtatagccctccagagtggatccgctaccatcgctaccatggcaggtcggcggcagtctggtccctggggatcctgctgtatgatatggtgtgtggagatattcctttcgagcatgacgaagagatcatcaggggccaggttttcttcaggcagagggtctcttcagaatgtcagcatctcattagatggtgcttggccctgagaccatcagataggccaaccttcgaagaaatccagaaccatccatggatgcaagatgttctcctgccccaggaaactgctgagatccacctccacagcctgtcgccggggcccagcaaatagcagcctttctggcaggtcctcccctctcttgtcagatgcccgagggaggggaagcttctgtctccagcttcccgagtaccagtgacacgtctcgccaagcaggacagtgcttgatacaggaacaacatttacaactcattccagatcccaggcccctggaggctgcctcccaacagtggggaagagtgactctccaggggtcctaggcctcaactcctcccatagatactctcttcttctcataggtgtccagcattgctggactctgaaatatcccgggggtggggggtgggggtgggtcagaaccctgccatggaactgtttccttcatcatgagttctgctgaatgccgcgatgggtcaggtaggggggaaacaggttgggatgggataggactagcaccattttaagtccctgtcacctcttccgactctttctgagtgccttctgtggggactccggctgtgctgggagaaatacttgaacttgcctcttttacctgctgcttctccaaaaatctgcctgggttttgttccctatttttctctcctgtcctccctcaccccctccttcatatgaaaggtgccatggaagaggctacagggccaaacgctgagccacctgcccttttttctgcctcctttagtaaaactccgagtgaactggtcttcctttttggtttttacttaactgtttcaaagccaagacctcacacacacaaaaaatgcacaaacaatgcaatcaacagaaaagctgtaaatgtgtgtacagttggcatggtagtatacaaaaagattgtagtggatctaatttttaagaaattttgcctttaagttattttacctgtttttgtttcttgttttgaaagatgcgcattctaacctggaggtcaatgttatgtatttatttatttatttatttggttcccttcctattccaagcttccatagctgctgccctagttttctttcctcctttcctcctctgacttggggaccttttgggggagggctgcgacgcttgctctgtttgtggggtgacgggactcaggcgggacagtgctgcagctccctggcttctgtggggcccctcacctacttacccaggtgggtcccggctctgtgggtgatggggaggggcattgctgactgtgtatataggataattatgaaaagcagttctggatggtgtgccttccagatcctctctggggctgtgttttgagcagcaggtagcctgctggttttatctgagtgaaatactgtacaggggaataaaagagatcttatttttttttttatacttggcgttttttgaataaaaaccttttgtctt

SEQ ID NO: 22622 - DNA, 2075 bp, Homo sapiens
agtagcattggggctggcgcgcgcggcgaatctcaacgctgcgccgtctgcgggcgcttccgggccaccagtttctctgctttccaccctggcgccccccagccctggctccccagctgcgctgccccgggcgtccacgccctgcgggcttagcgggttcagtgggctcaatctgcgcagcgccacctccatgttgaccaagcctctacaggggcctcccgcgccccccgggacccccacgccgccgccaggaggcaaggatcgggaagcgttcgaggccgagtatcgactcggccccctcctgggtaaggggggctttggcaccgtcttcgcaggacaccgcctcacagatcgactccaggtggccatcaaagtgattccccggaatcgtgtgctgggctggtcccccttgtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctccccagactgctgtgccctaatccgccggtgcctggcccccaaaccttcttcccgaccctcactggaagagatcctgctggacccctggatgcaaacaccagccgaggatgtacccctcaacccctccaaaggaggccctgcccctttggcctggtccttgctaccctaagcctggcctggcctggcctggcccccaatggtcagaagagccatcccatggccatgtcacagggatagatggacatttgttgacttggttttacaggtcattaccagtcattaaagtccagtattactaaggtaagggattgaggatcaggggttagaagacataaaccaagtctgcccagttcccttcccaatcctacaaaggagccttcctcccagaacctgtggtccctgattctggagggggaacttcttgcttctcattttgctaaggaagtttattttggtgaagttgttcccattctgagccccgggactcttattctgatgatgtgtcaccccacattggcacctcctactaccaccacacaaacttagttcatatgctcttacttgggcaagggtgctttccttccaataccccagtagcttttattttagtaaagggaccctttcccctagcctagggtcccatattgggtcaagctgcttacctgcctcagcccaggattctttattctgggggaggtaatgccctgttgttaccccaaggcttcttttttttttttttttttttgggtgaggggaccctactctgttatcccaagtgctcttattctggtgagaagaaccttacttccataatttgggaaggaatggaagatggacaccaccggacaccaccagacactaggatgggatggatggttttttgggggatgggctaggggaaataaggcttgctgtttgttctcctggggcgctccctccaacttttgcagattcttgcaacctcctcctgagccgggattgtccaattactaaaatgtaaataatcacgtattgtggggaggggagttccaagtgtgccctcctctcttctcctgcctggattatttaaaaagccatgtgtggaaacccactatttaataaaagtaatagaatcagaa

SEQ ID NO: 22623 - DNA, 892 bp, Homo sapiens
ttgaactcttgggctcaagcaatccacccacatcagcctcccaaagtgctgggattgcagggatgagccactgtgcctggccgaacttctttcgtttattcaaatgtttattgatctacgacatgcgagatttgtgcaggctctttgctggtttcaccctctcaatcgctgtgtgagtttgtgtctttagggaaagtgaggcccaggaagggaagtgagttgcttagcgacacactgtcaggaaaaggggccctgagttgagcttaggtaaaaagcctcagagctgttgccctgacatctgtcttttttctctccctgcttcccaccccacctgtgcccccagtcagactcagtcacatgcccactcgaagtcgcactgctatggaaagtgggtgcaggtggtgggcaccctggcgtgatccgcctgcttgactggtttgagacacaggagggcttcatgctggtcctcgagcggcctttgcccgcccaggatctctttgactatatcacagagaagggcccactgggtgaaggcccaagccgctgcttctttggccaagtagtggcagccatccagcactgccattcccgtggagttgtccatcgtgacatcaaggatgagaacatcctgatagacctacgccgtggctgtgccaaactcattgattttggttctggtgccctgcttcatgatgaaccctacactgactttgatgggacaagggtgtacagccccccagagtggatctctcgacaccagtaccatgcactcccggccactgtctggtcactgggcatcctcctctatgacatggtgtgtggggacattccctttgagagggaccaggagattctggaagctgagctccacttcccagcccatgtctcccca

SEQ ID NO: 22624 - DNA, 7151 bp, Homo sapiens
gcggcggcggctgcggtggcggcagccgaggcgagcggggcgggggcgcgggcgcggcgctcggagtccgttcggggccggaggcggtcggggccgggcccgggaagcgcgaggagcgcgcgtagcgccgccggagcccgccgcccgggacatggccaaggcgggccgtgcaggtggtcctcccccgggcggcggtgccccctggcaccttcgaaatgtcctcagtgactctgtggagagctcagatgatgaattctttgatgccagagaggagatggctgaagggaagaatgccatcctcattgggatgagccagtggaactccaatgacctcgtggagcagatcgagaccatggggaaactggacgagcatcaaggagaagggaccgcgccgtgcacatccagcatcctccaggagaagcagcgagaactgtaccgggtttccttgagaagacagaggttcccagcccagggaagcatcgagatccacgaagacagcgaggaaggctgcccgcagcgctcctgcaagacacatgtcctcctgctggtcctgcatgggggaaacatcctggacacgggtgccggggacccgtcctgcaaggcagccgacatccacaccttcagctccgtgctggagaaggtcacacgagcccatttccctgctgccctgggccacatcctcatcaagttcgtcccctgtcctgccatctgctctgaggctttctcgcttgtctctcacctgaacccctacagccacgatgagggctgcctcagcagcagccaggaccacgtccctctggccgcccttcccctgttggccatctcctccccgcagtaccaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagtgggttggaggatgaggagcccaagaggccgttgccgcggaaacagagcgactcctccacctatgactgcgaggccatcacccagcaccatgccttcctctcaagcatccactccagcgtgctaaaggatgagtctgagaccccggcggctggggggccgcagctccctgaggtcagcctgggccgctttgacttcgatgtgtccgacttcttcctcttcggctcgccactgggcctggtcctggccatgcggaggacggtgctgcctgggctggacggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgctgatgccctacacacccacagccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacgagcggccgctgccggcgctcagctgggcgcgtgggccccccaagttcgagtcggtgccctgaggggtgggctgtgctcagagcagggagcggggggcccaatcaggctgcctgcggggacgggagggggctgccctctccccgacacaggcgttttcctgctttttccctcccgtgtctgtccagcagtgtccgaccagagcggggagggatcctgcccgagcccggggggctccctgagctgcgacggggtgaggtccggggatctcggtgcagccactgctgcctcccacgggcctgcgaccgcaagcccaagtcagggttcatgtttgtgtcatcctgggggcaggcttgcccggggctgaagcgtttgggcaaagtcgaccaccctcctgcgtccccaggcttcacagcgagctaggcaggccctcaagggggcagccccagcctcggcaccaagcgccgctggcaggcacagcctctgggctgtcttgtggaggtgtgagtggcatttgtgcccgcccttcctgtggtttgggtcaccattttggggttggcgctcttatggcaagatggccactttctgggagtgagagcacatccccgggctcatgttacgccgtctctgtccacagccctcgggggtggggtctggtgctgacggtctgtcctgcagctgtccattgtccccaacccccgttgtcctcagtgtcctcaccatttccctgtggccctggaggccagggcttcctcttcccggagccctgcctcatgccctcccttgggaggctgcagccttgggctctggctcagctgggctggctgtgagcccctgagctggttgcttgccctctctgggctccgtcttccttctgttattggaggggtccccctagctgagattggtgtgagtctttgactcccaagatgtcctgcagtttggcccattgaggctcttcaggcctaagggtccctccgagtgtcctgtgacccacacctttcacacagcctgggagagggggtctgggtgggctggaaaggaggggctcttaaaggagcctctctgggtgggctgggaagggatccctactccacggagaggtgcagctggtttgccttgcactgcgtgtcccagggacaacccactcaaactgggtgtcctagggacaacccacctccctctcctgccaaaaggttactgattgggctccccataaccccagctctgccaggacccttttatcctttttggctcccagaggcatagagctgagattccagggttctaggggttcctggaagtttggctccaactgttgtattctcttccctttcccctgctgctcagtttgtgcccataacctcctcctgggtagtcccctgaggttggcaggacttggcccttctggggcccctaaagcctgctcaggccctcctgctgctgaaccttggcctgggcactgctttcctgcatcctggaaaaccccgactccctggcccaggcccacacctgctgtgtggggctgcccacgtggccactgagcccccataggctgccatcaaggccggtcccagcaatttcagccaggctgccccagggcccagacgtctgtatacacagcaggcacctgtgtcagctcagtgtcgcttctgctcaatgtctacctctcgcggctcccatgcagccagtgacgctgctggtgggggcggctggcaccgccgttgtgaattgcctggcaaattgggtgccctcctggggctggaggggtctgggctcctaacccccatccctgctctccccactagaaatgtgtcttcagtctgccagctcttctgctctacttccagtgctgcatcctgcactcaagcccagggctgctggcgagtctatggggaggagtgcggatcaggctcagcctcagcctcagcctcagcctcctctatggtcctgtctcctggcggttcacaggtgcccatcccccctttaacatttcacagttcttggctttccaaaggcaccagctcatatggcatagccaccccaaccctaatccttcccccaaatatcctgatttaaacttgggcagacttagtctgattcttgaaaactctaccatctccttcttgcagaaggcactggttacactaaaatgataaaataattagtatggggtactttgctcccagttacattccctcttccctgagaaccccaggctaggcgagagagggagagggagagagaaagagagagagggagagagagagagagagagggagagagaaagagagagagaaagaaaggaagacagaggaaagaaaggaagacagagagaggaaggcagagagagagagggagaaagaaagacaggaaggcagagagagagagagagagagaaaggaagacagagagagagagagaggaagagagagagagagaggaagagagagagagagctcatgagccaggatccctggggaatttgaagtcagtgtgaccagggttctgtggctctggggtcagagctgggacacaggacccagcaggagggccaccaccccttccttttggaaacagctctggttccaagcagcaatcaggtaggaggatcggggctttggctgatgatgcacacacaagatgctgatggtgtacggtgagatattgtgaacgcaacaactggagctgtagttggcgtgtgtgagtgtgtacctgcggttctgtttagtggcgagacaaggtatgtttcagtactgctttcacggcaactgtgtaatgcatatgctctttctacactagcggtttgctcagttttgtctgtccggttaagttggagaaagaaccaagttgtgttgttctctggagggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatcggcgggcggggggggggggtttgggtgccaagtgccctggaaacctattgtcttttggctcagccaaaagaaacattccctccttcctttccttccgggcttgggggaaaccttcgtaaaaatcatagttagggttaagtccaagcagtgaggcctgacctgggctctgctctccttgttgagacactaacaggcagttgggaggaaaatctgcatttgactccaccctctttggggcaaaggagaaacaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgccttta

SEQ ID NO: 22625 - DNA, 7042 bp, Homo sapiens
gcggcggcggctgcggtggcggcagccgaggcgagcggggcgggggcgcgggcgcggcgctcggagtccgttcggggccggaggcggtcggggccgggcccgggaagcgcgaggagcgcgcgtagcgccgccggagcccgccgcccgggacatggccaaggcgggccgtgcaggtggtcctcccccgggcggcggtgccccctggcaccttcgaaatgtcctcagtgactctgtggagagctcagatgatgaattctttgatgccagaggagaagggaccgcgccgtgcacatccagcatcctccaggagaagcagcgagaactgtaccgggtttccttgagaagacagaggttcccagcccagggaagcatcgagatccacgaagacagcgaggaaggctgcccgcagcgctcctgcaagacacatgtcctcctgctggtcctgcatgggggaaacatcctggacacgggtgccggggacccgtcctgcaaggcagccgacatccacaccttcagctccgtgctggagaaggtcacacgagcccatttccctgctgccctgggccacatcctcatcaagttcgtcccctgtcctgccatctgctctgaggctttctcgcttgtctctcacctgaacccctacagccacgatgagggctgcctcagcagcagccaggaccacgtccctctggccgcccttcccctgttggccatctcctccccgcagtaccaggatgctgtcgccaccgtcatcgagcgagccaaccaggtctacagagagttcctgaagtcctctgatgggattggcttcagtgggcaggtgtgtctcatcggggactgtgtggggggcctcctggccttcgatgccatctgctacagtgcggggccctcaggggacagccctgccagcagcagccggaaggggagcatcagcagcacccaggacaccccagtcgcggtggaggaagattgcagcctggccagcagcaagcgtctcagcaaaagcaacattgacatctccagtgggttggaggatgaggagcccaagaggccgttgccgcggaaacagagcgactcctccacctatgactgcgaggccatcacccagcaccatgccttcctctcaagcatccactccagcgtgctaaaggatgagtctgagaccccggcggctggggggccgcagctccctgaggtcagcctgggccgctttgacttcgatgtgtccgacttcttcctcttcggctcgccactgggcctggtcctggccatgcggaggacggtgctgcctgggctggacggcttccaggtgcgtcctgcctgcagccaggtctacagcttcttccattgcgcagacccctctgcctcacggctcgagccactgctggagcccaagttccacctggtgccgcctgtcagcgtgcctcgctaccagaggttcccactgggcgatgggcagtccctcctcctcgctgatgccctacacacccacagccccctcttcctggagggcagctcccgggacagcccgccacttctggatgcccctgcctcgccccctcaggcctcgaggttccagcgcccaggacggaggatgagcgaggggagctcccacagcgagagctcggagtcctcggacagcatggcacccgtgggtgcctcccgcatcacagccaagtggtggggaagcaagaggatcgactatgccctgtactgccctgatgtcctcacggccttccccaccgtggccctgccccacctcttccacgccagttactgggagtccacagacgtggtggccttcatcctgagacaggtaatgcgctatgagagcgtgaacatcaaggaaagcgcccgcctggaccctgcagcactgagtcctgccaacccccgggagaagtggcttcgtaagcggactcaggtcaagctgaggaatgtcacggctaatcaccgggccaatgatgtgattgctgctgaagatggcccccaggtcctggtggggcggttcatgtacgggcccctcgacatggtggctctgactggagagaaggtggacatcctagtaatggcagagccatcctcaggccgctgggtacacctggacacagagatcaccaacagcagtggtcgcatcacatacaatgtgccgcggccccggcgcctgggggttggtgtctatcctgtgaagatggtcgtcaggggcgaccagacctgtgccatgagctacctcacggtgttgcccaggggcatggagtgtgtagtgttcagcattgatgggtccttcgcggccagcgtgtctatcatgggaagcgaccccaaggtccggccgggtgcagtggatgttgtccggcactggcaggacttgggctacatgatcctttacatcacgggacggccggacatgcagaagcagcgggtggtgtcgtggctgtcccagcacaacttcccacagggcatgatcttcttctccgatgggctggtgcatgacccgctgcggcagaaggccatcttcctgcgcaacctcatgcaggagtgcttcatcaaaatcagtgcggcctatggctccacgaaggacatctctgtctacagcgtgctgggcctgcctgcctcccagatcttcattgtgggccggcccaccaagaagtaccaaacccagtgccagttcctgagcgagggctacgccgcacacctggccgcgctggaggccagccaccgctcacgcccaaagaagaacaactcgcgcatgatcctgcgcaagggcagcttcgggctgcacgcgcagccagagttcctgcggaagcgcaaccacctgcgcagaaccatgtcagtgcagcagcccgacccgcccgccgccaaccccaagcccgagcgggcccagagccagcccgagtcggacaaagaccacgagcggccgctgccggcgctcagctgggcgcgtgggccccccaagttcgagtcggtgccctgaggggtgggctgtgctcagagcagggagcggggggcccaatcaggctgcctgcggggacgggagggggctgccctctccccgacacaggcgttttcctgctttttccctcccgtgtctgtccagcagtgtccgaccagagcggggagggatcctgcccgagcccggggggctccctgagctgcgacggggtgaggtccggggatctcggtgcagccactgctgcctcccacgggcctgcgaccgcaagcccaagtcagggttcatgtttgtgtcatcctgggggcaggcttgcccggggctgaagcgtttgggcaaagtcgaccaccctcctgcgtccccaggcttcacagcgagctaggcaggccctcaagggggcagccccagcctcggcaccaagcgccgctggcaggcacagcctctgggctgtcttgtggaggtgtgagtggcatttgtgcccgcccttcctgtggtttgggtcaccattttggggttggcgctcttatggcaagatggccactttctgggagtgagagcacatccccgggctcatgttacgccgtctctgtccacagccctcgggggtggggtctggtgctgacggtctgtcctgcagctgtccattgtccccaacccccgttgtcctcagtgtcctcaccatttccctgtggccctggaggccagggcttcctcttcccggagccctgcctcatgccctcccttgggaggctgcagccttgggctctggctcagctgggctggctgtgagcccctgagctggttgcttgccctctctgggctccgtcttccttctgttattggaggggtccccctagctgagattggtgtgagtctttgactcccaagatgtcctgcagtttggcccattgaggctcttcaggcctaagggtccctccgagtgtcctgtgacccacacctttcacacagcctgggagagggggtctgggtgggctggaaaggaggggctcttaaaggagcctctctgggtgggctgggaagggatccctactccacggagaggtgcagctggtttgccttgcactgcgtgtcccagggacaacccactcaaactgggtgtcctagggacaacccacctccctctcctgccaaaaggttactgattgggctccccataaccccagctctgccaggacccttttatcctttttggctcccagaggcatagagctgagattccagggttctaggggttcctggaagtttggctccaactgttgtattctcttccctttcccctgctgctcagtttgtgcccataacctcctcctgggtagtcccctgaggttggcaggacttggcccttctggggcccctaaagcctgctcaggccctcctgctgctgaaccttggcctgggcactgctttcctgcatcctggaaaaccccgactccctggcccaggcccacacctgctgtgtggggctgcccacgtggccactgagcccccataggctgccatcaaggccggtcccagcaatttcagccaggctgccccagggcccagacgtctgtatacacagcaggcacctgtgtcagctcagtgtcgcttctgctcaatgtctacctctcgcggctcccatgcagccagtgacgctgctggtgggggcggctggcaccgccgttgtgaattgcctggcaaattgggtgccctcctggggctggaggggtctgggctcctaacccccatccctgctctccccactagaaatgtgtcttcagtctgccagctcttctgctctacttccagtgctgcatcctgcactcaagcccagggctgctggcgagtctatggggaggagtgcggatcaggctcagcctcagcctcagcctcagcctcctctatggtcctgtctcctggcggttcacaggtgcccatcccccctttaacatttcacagttcttggctttccaaaggcaccagctcatatggcatagccaccccaaccctaatccttcccccaaatatcctgatttaaacttgggcagacttagtctgattcttgaaaactctaccatctccttcttgcagaaggcactggttacactaaaatgataaaataattagtatggggtactttgctcccagttacattccctcttccctgagaaccccaggctaggcgagagagggagagggagagagaaagagagagagggagagagagagagagagagggagagagaaagagagagagaaagaaaggaagacagaggaaagaaaggaagacagagagaggaaggcagagagagagagggagaaagaaagacaggaaggcagagagagagagagagagagaaaggaagacagagagagagagagaggaagagagagagagagaggaagagagagagagagctcatgagccaggatccctggggaatttgaagtcagtgtgaccagggttctgtggctctggggtcagagctgggacacaggacccagcaggagggccaccaccccttccttttggaaacagctctggttccaagcagcaatcaggtaggaggatcggggctttggctgatgatgcacacacaagatgctgatggtgtacggtgagatattgtgaacgcaacaactggagctgtagttggcgtgtgtgagtgtgtacctgcggttctgtttagtggcgagacaaggtatgtttcagtactgctttcacggcaactgtgtaatgcatatgctctttctacactagcggtttgctcagttttgtctgtccggttaagttggagaaagaaccaagttgtgttgttctctggagggggtgctgctgcctctccttgagtagttctgtgacccccaatccagctgttttgtagagaatccttctagcttctggtatgcctgctctccagcagctggaaacagatcttcctgcctgaccaaagctccttgtttcttgcgtggcatgtttgttcttcccgatccggtggctgtcgtagccgagggcctgcctgccaccttcctttatcatttgccctgttggggttcagggtgcatccttagcccaggacctgctcttccagcatcatgggttttttcctaaagatctcaacggctcccttgggctccataaaatatttcttttttaaaaaagcagactcctttcatgcattgggatgaacggccctcttgtctgggtgctgggctacagcaaacaaatgtgtttgaatcccagtattccagagattcctggcggtgggctgtctagaagaggcgaggctggatctcacggtttttaaactgtatttttacccctttgggacccatacctgtgccctggagtctttcatgaggcacgtgggtcctctgcatcctcactctcccccctagcccaggtgcagccccgggaggggtgccctgaccccgccttaaacaaccaactttcccaccgaatcccatcggcgggcggggggggggggtttgggtgccaagtgccctggaaacctattgtcttttggctcagccaaaagaaacattccctccttcctttccttccgggcttgggggaaaccttcgtaaaaatcatagttagggttaagtccaagcagtgaggcctgacctgggctctgctctccttgttgagacactaacaggcagttgggaggaaaatctgcatttgactccaccctctttggggcaaaggagaaacaggtgacccgagggggggcaggccagaggagggcgactcgtgcacagggacccccacccttggaccccgctgtccttttctagttgtttacttggtggtggcagccagtctgaccttgtctgtggtctgactgttcctaagtgtgtaactttcagtattatctgtgacagatggttctgtggtgaaaaaggtttattatattccttatggctgccttgtacaaaatccgttagaaacgctaatgtaagatatcagatttctaacaagacaaaaacagcattatggagttaaaagatttttacaactgggtcttgattttgatgtgagctggtttttagctctcaaatgttgtcacttaaataaaaaccttctttgccttt

SEQ ID NO: 22626 - DNA, 750 bp, Homo sapiens
gtggtttaaaccaggagtgcgccgcgtccgttcaccgcggcctcagatgaatgcggctgttaagacctgcaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacagatt

SEQ ID NO: 22627 - DNA, 1070 bp, Homo sapiens
cgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaagtacttgttggctcacgcccgtgactgttccgctgtttagctcttgttttttgtgtggacactcctaggatagaaagtttggtatgttgctatacctttgcttctcccaccttccccaatatctaatatgtatttctcattcttagaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttgtgtgtatttgtattaataaagcattctttaacaga

SEQ ID NO: 22628 - DNA, 895 bp, Homo sapiens
gagggtcgcgggtggttagttgagccggctccggcggggaaggaggcgggctgcggctgcggctggggctgaagctggggctggggttgggggactgcccggggcttagatggctccgagcccgtttgagcgtggtctcggactgctaactggaccaacggcaactgtctgatgagtgccagccccaaaccgcgcgctgctcgggaccttagagcctctgactcaggctggaagatttgagagctggattaaaataatccagaatggctactctgatctatgttgataaggaaaatggagaaccaggcacccgtgtggttgctaaggatgggctgaagctggggtctggaccttcaatcaaagccttagatgggagatctcaagtttcaacaccacgttttggcaaaacgttcgatgccccaccagccttacctaaagctactagaaaggctttgggaactgtcaacagagctacagaaaagtctgtaaagaccaagggacccctcaaacaaaaacagccaagcttttctgccaaaaagatgactgagaagactgttaaagcaaaaagctctgttcctgcctcagatgatgcctatccagaaatagaaaaattctttcccttcaatcctctagactttgagagttttgacctgcctgaagagcaccagattgcgcacctccccttgagtggagtgcctctcatgatccttgacgaggagagagagcttgaaaagctgtttcagctgggccccccttcacctgtgaagatgccctctccaccatgggaatccaatctgttgcagtctccttcaagcattctgtcgaccctggatgttgaattgccacctgtttgctgtgacatagatatttaaatttcttagtgcttcagagtttg

SEQ ID NO: 22629 - DNA, 2760 bp, Homo sapiens
gcgcaggcgcactgaacctcagccgcgccgggaggcgagcccgttggcgaggggcggggcagatggcgagggagcggggcgagctgctttttgaggctgcgcactcgcatggccccacctcgcaggtccacttccggcgccgcggctgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctcctgtctttggtgcaacactaacaaggcttgtctggactacccagttacaagcgtcttgccaccggcttccctttgtaaattgagctctgcacgctggggagtttgttgggtgaactttgaggcgctgatcatcaccatgtcggtagtcgggggaaccctcctcctgggcattgccatctgctgctgctgctgctgcaggaggaagaggagccggaagccggacaggagtgaggagaaggccatgcgtgagcgggaggagaggcggatacggcaggaggaacggagagcagagatgaagacaagacatgatgaaatcagaaaaaaatatggcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggccatttagggatcgtggggacggggtccaccccaagaagaaagaaaggcccgtccacaggcccggctctgggccacgtgccccggaagcaggtgtgtccagagtcagctgagggctctccccacaccacccagcaggcgctggtgctccttctgcctcatgggaccagtccagcttccagccgctctggctcgagggtggtctgaccacttccttctgagtgggcttctctgggagctctccagtggcactgctggacctgcccacgtttctgtaaaatcaggatacgtggctttagtaagcagaccaagcgcttcgtggcagggaaagcagcgtgcggggaagtcactgaaaagtgctgcctaaggaagtttggaaatagtccctgttccagattgccttgaattttaaaacattttgctttgggaaagtaggtcagcagcacctaagatcaaggatgcgttccattttcacacttcacagtcatgaaaactgagaagactgtcttcagcgtgaactaaagttcacaggcagatcactgatccagaacacttcaagaactcgtcaaacagctcgataagcctttttgactgtgtacatctgtaccgggaataacattcctaggctgaaatttccacaaagaatagaacctgtacccagttcttcaggctgatttccctgacctcttgggcatttgtatttgtagtaaagtattgcagagattcctaagtattttatagcagccatcaaaattggactttgtattgtttattcataaaagacacttggtaatagacttcagtgaactctgtatgaatgcagtagtgtgtgtgcaaaatccgcttcctgagcgtagggtgctgagctggcgctagggctcggttgtgaaatacagcgtagtcagcccttgcgctcagtgtagaaacccacgtctgtaaggtcggtcttcgtccatctgcttttttctgaaatacactaagagcagccacaaaactgtaacctcaaggaaaccataaagcttggagtgccttaatttttaaccagtttccaataaaacggtttactacctgcgtgtgtttagta

SEQ ID NO: 22630 - DNA, 1205 bp, Homo sapiens
tgttccgggcggagaccgcttgtgctggagtcggagttgtaacgctccactgactgatagagcgaccggccgaccatggcgcccggagtggcccgcgggccgacgccgtactggaggttgcgcctcggtggcgccgcgctgctcctgctgctcatcccggtggccgccgcgcaggagcctcccggagctgcttgttctcagaacacaaacaaaacctgtgaagagtgcctgaagaacgtctccgcctgtttaaagaagaaaacccgtatgctagatttgaaaacaactaaagcgctccagcacatcagtcccgacgcttcctgtgaggtgcacgctccgcagcccagcccagccgggagaccacgtggccattgcggtctcctgaccttggccagtgaacctgccagccttccaggacaggcggccggagagctgcccctgaaggacagtcctctcgtcttgcagactggtgaccttctattccctgttcatctctgtttctagatttagtcacttgaaataagaaatctttggggtttgggcttttttatactcttctcagtttgtgaaacgctaactgcacacgaagccgcctgacggcacccagcgctgtggctgtcattctcccagggcagaaccctgcgtttctctctgtccactaacaagcttcacacgcaacacagggaagtcggtttgacttttgtcatgaggagaactgaccagccctcatcattccccataaaaccacggacagcgtctgtgtgcgcatcttgagtcttcacacctgttgactcacacggcttttgctgatgacacggggctccagtacacagtctgataaggacttaacgtcctaacctcaattgtattaaatagcattggggaatagctaaacctttttaaaaaaatttattggattttcctccctgcttaaaagatttcaccagaaaaccttcatataaaaattcaggccctttttggacaatttttaaaatttgtatctttactagaacatgagaatctttttcccttggaagcttgaattataaatgtggtgtttggcctgcctcagcagcaccagttgactgctcgtgtgccagcggtgtggggaggacggggcaggacgctgcagctctctccagccctgttggcatcctcagtgcctgcaggcctctcgctgcctgttgggctgtctggggggtggc

SEQ ID NO: 22631 - DNA, 691 bp, Homo sapiens
atggctactctgatctacgttgataaggaaattggagaaccaggcacccgtgtggctgccaaggatgtgctgaagctggagtctagaccttcaatcaaagcattagatgggatatctcaagttttaacacgacgttttggcaaaacatacgatgctccatcagccttacctaaagctaccagaaaggctttgggcactgtcaacagagctacagaaaagtcagtaaagaccaatggacccagaaaacaaaaacagccaagcttttctgccaaaaagatgaccgagaagactgttaaaacaaaaagttctgttcctgcctcagatgacgcctatccagaaatagaaaaattctttcccttcaatcttctagactttgagagttttgacctgcctgaagagcgccagattgcacacctccccttgagtggagtgcctctcatgatccttgatgaggagggagagcttgaaaagctgtttcagctgggccccccttcacctgtgaaaatgccctctccaccatgggaatgcaatctgtttgcagtctccttcaagcattctgtcgaccctggatgttgaattgccagctgtttgctatgacatagatatttaaatttcttagtgctttggagtttgtgtgtacttgtattaataaagcattatttgtttaacaacataataaatacataaatat

SEQ ID NO: 22632 - DNA, 3897 bp, Homo sapiens
gttactgggcgtatggcgtacagacacgaggccggcgcccgggaggcggtgttcatccgcccgggaaaagagcgcctgttgctcgctgcccgcgtgtccctggctctctcgggaacccagcgccgaaggcgaggtgggcgcgggccgaaggaggtcctgggaggtcggcggcgcggagggatctccgcgggagccgttggggctgttggcctcgggctgaggtgcaaggaccaggactagggcgagggcagcggtccaagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaagactacagcaaaaggttactgaagtttttagtaagacccggaatggagaggatgtgaggataacgatcactttaacaaatgaacttccacctacatcaccaacttgtttgcagttctataatattattttcaggaggcttttgaaaatcatgaatttgcaacaaattggacgaaattattataacccaaatgacccaattgatattccaagtcacaggttggtgatttggcctggcttcactacttccatccttcagtatgaaaacagcatcatgctctgcactgacgttagccataaagtccttcgaagtgagactgttttggatttcatgttcaacttttatcatcagacagaagaacataaatttcaagaacaagtttccaaagaactaataggtttagttgttcttaccaagtataacaataagacatacagagtggatgatattgactgggaccagaatcccaagagcacctttaagaaagccgacggctctgaagtcagcttcttagaatactacaggaagcaatacaaccaagagatcaccgacttgaagcagcctgtcttggtcagccagcccaagagaaggcggggccctggggggacactgccagggcctgccatgctcattcctgagctctgctatcttacaggtctaactgataaaatgcgtaatgattttaacgtgatgaaagacttagccgttcatacaagactaactccagagcaaaggcagcgtgaagtgggacgactcattgattacattcataaaaacgataatgttcaaagggagcttcgagactggggtttgagctttgattccaacttactgtccttctcaggaagaattttgcaaacagaaaagattcaccaaggtggaaaaacatttgattacaatccacaatttgcagattggtccaaagaaacaagaggtgcaccattaattagtgttaagccactagataactggctgttgatctatacgcgaagaaattatgaagcagccaattcattgatacaaaatctatttaaagttacaccagccatgggcatgcaaatgagaaaagcaataatgattgaagtggatgacagaactgaagcctacttaagagtcttacagcaaaaggtcacagcagacacccagatagttgtctgtctgttgtcaagtaatcggaaggacaaatacgatgctattaaaaaatacctgtgtacagattgccctaccccaagtcagtgtgtggtggcccgaaccttaggcaaacagcaaactgtcatggccattgctacaaagattgccctacagatgaactgcaagatgggaggagagctctggagggtggacatccccctgaagctcgtgatgatcgttggcatcgattgttaccatgacatgacagctgggcggaggtcaatcgcaggatttgttgccagcatcaatgaagggatgacccgctggttctcacgctgcatatttcaggatagaggacaggagctggtagatgggctcaaagtctgcctgcaagcggctctgagggcttggaatagctgcaatgagtacatgcccagccggatcatcgtgtaccgcgatggcgtaggagacggccagctgaaaacactggtgaactacgaagtgccacagtttttggattgtctaaaatccattggtagaggttacaaccctagactaacggtaattgtggtgaagaaaagagtgaacaccagattttttgctcagtctggaggaagacttcagaatccacttcctggaacagttattgatgtagaggttaccagaccagaatggtatgacttttttatcgtgagccaggctgtgagaagtggtagtgtttctcccacacattacaatgtcatctatgacaacagcggcctgaagccagaccacatacagcgcttgacctacaagctgtgccacatctattacaactggccaggtgtcattcgtgttcctgctccttgccagtacgcccacaagctggcttttcttgttggccagagtattcacagagagccaaatctgtcactgtcaaaccgcctttactacctctaacctgcagaagacgatgcagccgcttttctttttgaaatgactttgggatttttttaagcttttatttactttttttttaactgttatctttctggatgaaacttgggaaggggattaggagatctagcattttatttctagcattgctattcaccggcttccttattttatacgtaaaaattaagattttatattttatcttcttgtttctcatagatattttgtgagcatttttttgtttattttgaagaaatgtggataagatacttggtagtataaaacagactctctgagagtatttgaaatgtgtttggagatttacttaaacgtactttcaggagtgagcaagtcctacttataaacctatattaactttatttttgagatacctgttttgaatttaaaggagataagaggcgtaaagtaggatgctcactacaaccataggtggggtttcagctcatatcttaaagataaaaggtactattatataacctatacacaagatacaggagaaaatatgcttgatttttatttggcaggggggctaggttgtatgggagtaaaaaaaacattgaaaatttttaaattgtccaaagaaacattttaagactctttaacaaaaaaggccatgagtaaatctctatattaacattactatttattttgttttggaactgggacatgattctatttgttataaaataaaattgatgtgattgtcaccttatttgaataactgtaattcttgttttactgaaagtatgtgcgttttcttttcatttaatttttaaaagtgcatacaattccattcataaaagctaaattagcctgaccaacatggtgaaaccccatctctactaaaaatacaaaattagccagatgtggtgccaggaggctgaggcaggagaatcacttgaacctgagaggcggaggttgcagtgagcagagatcacgccactgcactccagcctgggcaacagagtgagactccgtctcaaaaaaaaaaaaaaaaaaaaaaaaaaaaaaaaaaaaaaaa

SEQ ID NO: 22633 - DNA, 467 bp, Homo sapiens
agcggtccaaggtgcggggccaggctgaggtgctaggtgtgcgggggccgggatgcgggggcggcggctgggggtccgggatgtggagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacat

SEQ ID NO: 22634 - DNA, 545 bp, Homo sapiens
gtgcacggcgtggtcctgagctcagcgccggagggacgttaggtggaagcgtctttggcagagctggtagcgaatcggagagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttcttt

SEQ ID NO: 22635 - DNA, 879 bp, Homo sapiens
atctccaaatgggaaagaaagaaccagccaccagcatcctaattctttcagcactttctcctcctaagtctgtttataataaataatccaaatgaaaaactaagtcttatattaaaataggttttcccctttggccctactgcagtgcccagtgcaaggtaagcaactgagtttgttgaatgtaggaatgttacattaaaaaaaactgtcattaaagattagaaggatacataataattgcctggggagcttacttttgaaactcaaagaagtttaaagtaacattgtagaaattatcaaatgcgattgcctccattgagtattgtcttcaagattgtttcctctccagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatggaacgatattatttttacctaaaag

SEQ ID NO: 22636 - DNA, 571 bp, Homo sapiens
gtgcaaggaccaggactagggcgagggcagcggtccaaggtgcggggccaggctgaggtgctagaaatagaaaacaatgactgggagagcccgagccagagccagaggaagggcccgcggtcaggagacagcgcagctggtgggctccactgccagtcagcaacctggttatattcagcctaggcctcagccgccaccagcagagggggaattatttggccgtggacggcagagaggaacagcaggaggaacagccaagtcacaaggactccagatatctgctggatttcaggagttatcgttagcagagagaggaggtcgtcgtagagattttcatgatcttggtgtgaatacaaggcagaacctagaccatgttaaagaatcaaaaacaggttcttcaggcattatagtaaggttaagcactaaccatttccggctgacatcccgtccccagtgggccttatatcagtatcacattgactataacccactgatggaagccagaagactccgttcagctcttctttttcaacacgaagatctaattggaaagtgtcatgcttttgatgga

SEQ ID NO: 22637 - DNA, 5128 bp, Homo sapiens
gaaattggccctggagcatgtgggccccggggcgtgggttgagctcggtcttcccctgaggccgcgcggagctgggcgactggggcgaggactcgcgcacaggtaattaaccagaacaggatcgacacgtgttctctacagcccgtccatggatcctttccgaccatcgttcaggggccagtctcctatccacccatcccagtgccaggctgtacggatgccaggctgttggccacaagcttctaaacctttggacccagctctgggcaggggagcacctgcaggcagaggccatgtatttggaaagccagaggaaccaagcacacagagggggccagcacaaagggagtctgtgggtttggtctccatgttccgaggcctgggcattgaaacagtttctaagacccctctgaaacgggaaatgcttccatcaggtagaggcattttaggtcgaggcttgtctgctaatctggtacgcaaggacagggaggaactctctcccactttttgggatccaaaagtgttggcggctggggacagcaagatggcagagacctccgttggttggagtaggacgcttggaagagggagttcagatgcgtctttattaccactgggaagagcagcaggtggtatcagcagagaagtggacaagcctccctgtaccttcagcacaccgtcccggggtcccccgcagctgtcatcaccaccagctctgccccagtctcccctgcactctccagatcgccctctggtcctgactgtggaacacaaggaaaaagagcttattgtgaagcaaggatcaaaaggaacacctcagtctttgggactgaacctcgtcaaaatacagtgtcataatgaagcagtttatcaatatcatgtgactttcagccccaatgtggagtgcaaaagcatgaggttcggcatgttgaaggaccatcaagctgtcaccggcaacgtcactgcgtttgatggatctattctctatctgcctgttaagcttcaacaagttcttgagttaaaaagtcaaaggaaaacagacagtgctgaaatcagcattaagattcagatgacaaagatcctggagccctgctctgacctgtgcattcccttctacaatgttgttttccgtcgggtaatgaaacttttagatatgaagcttgtggggagaaacttttatgaccctacaagtgctatggtactacagcaacacagattgcagatctggccaggctatgcagctagcatccgaaggacagatggagggctcttcctgctagctgatgtctcccataaggtcattcggaatgactgtgtgctggatgtcatgcatgccatttatcagcagaataaagaacacttccaggatgagtgtactaagcttctggttggcaatattgttatcacccgatataacaatcgtacctatcgtattgatgatgtggattggaataagactccaaaggatagcttcacgatgtctgatgggaaagagatcacattcttggaatactacagcaaaaattatgggatcacagttaaggaagaggaccagccattgctgattcacaggcccagtgagagacaggataatcatgggatgctgctaaaaggggaaatcctgctgctgcctgagctttcttttatgaccggaatcccagagaagatgaagaaggacttcagagccatgaaggatttggctcagcaaatcaatctgagccccaagcaacaccatagtgctttggaatgcttgctgcaaagaattgcaaagaacgaggcagccaccaatgaactgatgcgttgggggctccgtctgcaaaaggatgtacataagattgaaggacgtgttctgccaatggaaagaattaacttaaaaaatacttcgtttatcacatctcaggaactaaactgggttaaggaagtaaccagagacccttccatcttgactatccccatgcatttctgggcacttttttacccaaagagagcaatggaccaggctcgagaactggtcaacatgttggagaagatagccggccccattggcatgcgtatgagcccaccggcctgggttgaactaaaggatgaccgaatagagacttatgtcagaaccattcaatccacgttaggagctgaggggaagatacagatggttgtttgcatcatcatgggcccacgtgatgatctctatggggccatcaagaagctgtgctgtgtgcagtccccagtgccctcccaggttgtcaatgttcgaaccattggtcagcccaccaggcttcggagtgtggcccagaagattttacttcagattaactgtaaattgggtggtgagctctggggagtggatattcctctgaaacagttaatggtgatcgggatggatgtttaccatgaccccagtagaggcatgcgctccgtggttggcttcgtggcaagcatcaatctcaccctcacaaaatggtattcccgggtggtgttccagatgccgcatcaggagattgtggacagcctgaagctatgcctcgtgggctccttaaaaaagttttatgaggtgaaccactgtctaccagagaagattgtggtgtaccgtgatggagtgtctgatggccaactgaagacagttgccaactatgagattcctcaactacagaagtgttttgaagcttttgagaattatcagcccaagatggtggtgtttgtagttcagaagaaaatcagtactaatctatatctggctgctcctcagaactttgtaactcccactcctggaactgtggtagatcatacaataacaagctgtgagtgggtggatttctatcttcttgcccatcatgtacggcagggctgtggcattcctacgcattatgtctgtgttctcaacaccgcaaacctgagccctgatcatatgcagaggctgactttcaaactgtgccacatgtactggaattggcctggcaccatcagagttccagctccttgcaagtatgcccacaagctagctttcctgtcaggacacatcttgcatcatgaaccagccatccagctgtgcgagaacctgttcttcctgtgactgcacagcttggagatgggctggtgagaagaaaggcggcctcagaactcagctgtgactcttgcagaatcaacagagactgaagtgggcttttgtgttataattttccctttctccaaccctgtagaataagatttctttcttgtcttttaaacctaatatcaccaagaagcaagtttctgagtaacagctgaaaatggccttgttgcctgtgtagagcaagttacggtggtactgccactctgcaggtggagcgggtgactctgggggaccattaagacctccagaccgggtgcggtggttcacacctgtaatccaagcactttgggaggccgaggcgggtggatcatgaggtcaggagatcaagaccatcctggccaacatggtgaaaccccgtctctactaaaatacaaaaaaattagccgggtgtggcggtgcacgcctgtagtcccagctactcaggaggctaaggcaggagaatcgcttgaacccgggaggtggaggttgcagtgagccgagatcacgccactgcactccagcctgttgacaaagcaagactctgtctcaaaaaaaaaaaaaaaaagccaacatgagctgcagaaaccagcagaagcagccattatacttctaagctgtgccaactaagtggttcccatttctggagccagagatgataattaagtcattgcaagttgcctgaagagaattactcaggcaactgggaaaggcagtggaaggtctgtgaagcaaagttttcaagtagatattgctattactggcaggtgtgcaaggcgtgtagtaaaatcagtttgtggcataggtcggcccttgctgactaaatcctctctggggattgaattgatgacgactgtgacttgagttggattcgaaaatggcttcccttggcctcttgaaagagtgcagatgaagccttttccgtggatttcagtaactttccagcataccatgacgatttcttccccaaatatacacatgctcttttgctctttgtgcctgatcttcagtaatttttagttttttaacaggcagaaaaaatctagcagctaggaaagttcaagttggggtgggagtttttagtgaacttttctcccaggtgtgtggcctttatttctatttatatatgtttgtaaatggaattaccccctttctcttgcaaaataaccgcttcctggctgttggctcactttgctggaatttttctgaatccaggttaagatttccagaagtcagctttggaaaacgtgacactcctaccaaagtccagatggttagaaagttatcacataccatgggtttcagtgtttttggaaacccgtttttttctggttttttttcccccctctccattttagaatcttctcccagtcccttcgggcctagttctgtctcatcttgctttattgggttttaaaaaccggtcttatttaagcttttctaatttgtatttatgtacttatttattttttggtatgatggcagggaggggacaaagcagaaataccccttttatatgacaatgtgtgagaaaagaaactttagcttaaaactccgtaaaatgtgctcacttcagcagcacatatactaaaattaaaatgatatagagaagattagcatatagaaaaaaagaaaaaagatttccttaaaacaagaaaaccaagaatgtttttggtttgttgcggtgcccagccgaggttgaggagggatgggtattgttggtgcactgctggtttcatttggagtgtgggacattagggtgagacaaggacctggaatttaaaaaccacagaatcaaacactgtgaaccactggtctctggctaagcagatcagttttctgattttccttggaagcgttttgaatttttctgttgaagttggatttcctaatactttttttctcttagataatcagaacaaatggttgaatacattataatacaaaaatttcttcactttttattcttggttttcttgcctcgtttttcggttttaatgccaaatgattgggtcatggggtgggaaataaaaacaactttgt

SEQ ID NO: 22638 - DNA, 3442 bp, Homo sapiens
attcgaggcccggcgccgcggccccaagaaggtgtccaggttggggcggcaggggaggccctccggaggcccaagtggacgtcttatttggcctgagagaggagatagaacccctggcagggctgtggctttggggaaaggtgcttttctcggggtggaaaggggatgggactcgccttcgggggccttgcttctggttaggcccgagtcgcgaggcctcagcgcggagcacgcacccagggatgcgagggaggcaggcccagcccgtcctgggttcgctccccattgaacctttcggacagccaagtatctgctacctgatcccagggggaaacccacactgggagagggccctctgggggagctacctgaatctatagaagtggtgctggaggttgagggaagcgtggacaaagaggaagattccagatgtcccttaagggaggccgtccagcgcttctgagtaattaaccagaacaggatcgacacgtgttctctacagcccgtccatggatcctttccgaccatcgttcaggggccagtctcctatccacccatcccagtgccaggctgtacggatgccaggctgttggccacaagcttctaaacctttggacccagctctgggcaggggagcacctgcaggcagaggccatgtatttggaaagccagaggaaccaagcacacagagggggccagcacaaagggagtctgtgggtttggtctccatgttccgaggcctgggcattgaaacagtttctaagacccctctgaaacgggaaatgcttccatcaggtagaggcattttaggtcgaggcttgtctgctaatctggtacgcaaggacagggaggaactctctcccactttttgggatccaaaagtgttggcggctggggacagcaagatggcagagacctccgttggttggagtaggacgcttggaagagggagttcagatgcgtctttattaccactgggaagagcagcaggtggtatcagcagagaagtggacaagcctccctgtaccttcagcacaccgtcccggggtcccccgcagctgtcatcaccaccagctctgccccagtctcccctgcactctccagatcgccctctggtcctgactgtggaacacaaggaaaaagagcttattgtgaagcaaggatcaaaaggaacacctcagtctttgggactgaacctcgtcaaaatacagtgtcataatgaagcagtttatcaatatcatgtgactttcagccccaatgtggagtgcaaaagcatgaggttcggcatgttgaaggaccatcaagctgtcaccggcaacgtcactgcgtttgatggatctattctctatctgcctgttaagcttcaacaagttcttgagttaaaaagtcaaaggaaaacagacagtgctgaaatcagcattaagattcagatgacaaagatcctggagccctgctctgacctgtgcattcccttctacaatgttgttttccgtcgggtaatgaaacttttagatatgaagcttgtggggagaaacttttatgaccctacaagtgctatggtactacagcaacacagattgcagatctggccaggctatgcagctagcatccgaaggacagatggagggctcttcctgctagctgatgtctcccataaggtcattcggaatgactgtgtgctggatgtcatgcatgccatttatcagcagaataaagaacacttccaggatgagtgtactaagcttctggttggcaatattgttatcacccgatataacaatcgtacctatcgtattgatgatgtggattggaataagactccaaaggatagcttcacgatgtctgatgggaaagagatcacattcttggaatactacagcaaaaattatgggatcacagttaaggaagaggaccagccattgctgattcacaggcccagtgagagacaggataatcatgggatgctgctaaaaggggaaatcctgctgctgcctgagctttcttttatgaccggaatcccagagaagatgaagaaggacttcagagccatgaaggatttggctcagcaaatcaatctgagccccaagcaacaccatagtgctttggaatgcttgctgcaaagaattgcaaagaacgaggcagccaccaatgaactgatgcgttgggggctccgtctgcaaaaggatgtacataagattgaaggacgtgttctgccaatggaaagaattaacttaaaaaatacttcgtttatcacatctcaggaactaaactgggttaaggaagtaaccagagacccttccatcttgactatccccatgcatttctgggcacttttttacccaaagagagcaatggaccaggctcgagaactggtcaacatgttggagaagatagccggccccattggcatgcgtatgagcccaccggcctgggttgaactaaaggatgaccgaatagagacttatgtcagaaccattcaatccacgttaggagctgaggggaagatacagatggttgtttgcatcatcatgggcccacgtgatgatctctatggggccatcaagaagctgtgctgtgtgcagtccccagtgccctcccaggttgtcaatgttcgaaccattggtcagcccaccaggcttcggagtgtggcccagaagattttacttcagattaactgtaaattgggtggtgagctctggggagtggatattcctctgaaacagttaatggtgatcgggatggatgtttaccatgaccccagtagaggcatgcgctccgtggttggcttcgtggcaagcatcaatctcaccctcacaaaatggtattcccgggtggtgttccagatgccgcatcaggagattgtggacagcctgaagctatgcctcgtgggctccttaaaaaagttttatgaggtgaaccactgtctaccagagaagattgtggtgtaccgtgatggagtgtctgatggccaactgaagacagttgccaactatgagattcctcaactacagaagtgttttgaagcttttgagaattatcagcccaagatggtggtgtttgtagttcagaagaaaatcagtactaatctatatctggctgctcctcagaactttgtaactcccactcctggaactgtggtagatcatacaataacaagctgtgagtgggtggatttctatcttcttgcccatcatgtacggcagggctgtggcattcctacgcattatgtctgtgttctcaacaccgcaaacctgagccctgatcatatgcagaggctgactttcaaactgtgccacatgtactggaattggcctggcaccatcagagttccagctccttgcaagtatgcccacaagctagctttcctgtcaggacacatcttgcatcatgaaccagccatccagctgtgcgagaacctgttcttcctgtgactgcacagctt

SEQ ID NO: 22639 - DNA, 1131 bp, Homo sapiens
atatatcagaccatcagaaggatttgtataaagagtgactctcctatgaaggtaaaggccacccctcttcagttccagtgactgagatacatttttccaatcctgggggcaaatacagacacagcaagttccttcttccctttggaaatttggcagctgccttcaccagtgagcacaaagccacatttcaaaggaaactgacaaattatccccagctgccagaagaagaaatcctcactggacggcttcctgtttcctgtggttcattatctgattggctgcagggatgaaagtttttaagttcataggactgatgatcctcctcacctctgcgttttcagccggttcaggacaaagtccaatgactgtgctgtgctccatagactggttcatggtcacagtgcaccccttcatgctaaacaacgatgtgtgtgtacactttcatgaactacacttgggcctgggttgccccccaaaccatgttcagccacacgcctaccagttcacctaccgtgttactgaatgtggcatcagggccaaagctgtctctcaggacatggttatctacagcactgagatacactactcttctaagggcacgccatctaagtttgtgatcccagtgtcatgtgctgccccccaaaagtccccatggctcaccaagccctgctccatgagagtagccagcaagagcagggccacagcccagaaggatgagaaatgctacgaggtgttcagcttgtcacagtccagtcaaaggcccaactgcgattgtccaccttgtgtcttcagtgaagaagagcatacccaggtcccttgtcaccaagcaggggctcaggaggctcaacctctgcagccatctcactttcttgatatttctgaggattggtctcttcacacagatgatatgattgggtccatgtgatcctcaggtttggggtctcctgaagatgctatttctagaattagtatatagtgtacaaatgtctgacaaataagtgctcttgtgaccctcatgtgagcacttttgagaaagagaaacctatagcaacttcatgaattaagcctttttctatatttttatattcatgtgtaaacaaaaaataaaataaaattctgatcgcataaaaa

SEQ ID NO: 22640 - DNA, 785 bp, Homo sapiens
gctgcgggcagacgcggcgctgcgctcggccaggccggcaccatgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggagatggtagagaagaccgtggatcacctggggacagaggtgaaaggcctgctgggcctgctggaggagctggcctggaacctgcccccgggacccttcagccccgctcccgaccttctcggagatggcttctgagccctggagctggagcccagcagttggaggtggtgcacctgccaggcagcgcccacagaaccagccctgtcctctcgacttccttccttagcttcatgtgaaataaaagctattctggtctcctctgtgtctgctgacagagtaacccgtttaactacagcctcctctcactccacttccatgcctggaggaagcctgcaaccccctccaggctcagacctggggacacccccactcctgtcatttataggggcagatggagcaggggttgattcacacagatgggggccctttgagtggccttgcttctcaaaatgtggccataggtgaaaagcaaggggatcagggtctcaggacccacccagactgtttaatccaaatctgcattgcaatgagacccccagggattttatgtgtccattaaagtggtttgttgttgtttttaaaaa

SEQ ID NO: 22641 - DNA, 472 bp, Homo sapiens
cacggggtgccgaggggcctctggagggggcgggttctctcgagccagaaagtccggagccgcccaggaattttggctcgaactgagtgcatttcctctcgggccggccgggtgcgatccgggaagggcggctgcgggcagacgcggcgctgcgctcggccaggccggcaccatgcggcccctgctctgcgcgctgaccggactggccctgctccgcgccgcgggctctttggccgctgccgaacccttcagccctccgcgaggagactcagctcagagcacagcgtgtgacagacacatggctgtgcaacgccgtctagatgtcatggaggagatggcttctgagccctggagctggagcccagcagttggaggtggtgcacctgccaggcagcgcccacagaaccagccctgtcctctcgacttccttccttagcttcatgtgaaataaaagctattctggtctcctctg

SEQ ID NO: 22642 - DNA, 495 bp, Homo sapiens
gggagtgagaactggatcactggttagcgtggtaactgttttggacaattgcatagccacagccaggaacacagaaggcagagaggcagccttgatctgcaagagctccagctgccgaacccttcagccctccgcgaggagactcagctcagagcacagcgtgtgacagacacatggctgtgcaacgccgtctagatgtcatggaggagatggtagagaagaccgtggatcacctggggacagaggtgaaaggcctgctgggcctgctggaggagctggcctggaacctgcccccgggacccttcagccccgctcccgaccttctcggagatggcttctgagccctggagctggagcccagcagttggaggtggtgcacctgccaggcagcgcccacagaaccagccctgtcctctcgacttccttccttagcttcatgtgaaataaaagctattctggtctcctctgtgtctgctgacagagtaacccgtttaa

SEQ ID NO: 22643 - DNA, 5447 bp, Homo sapiens
gggtggtgcagggcaggggtggtatatcctgtctgacggagggcgggcctcgccagtgccagagagggacgaaccagggtggaagcgccaggagcagctgcagggagccctcacgcggaccacgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaaataccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctatgcagtatttgggaaagttcacaagaaactgagaagaaacctaaaaactgtggatagtggaaagatttttagattttttttttccttggggaaactggcaggcaatgggggttagggaggttggggcggtgggggctttcttgagttaaaggggcttatatgtgatgtcaatatttcttcctctgagaaatggtatatatatgtgtataatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccacttacaaggctgctttccaggaagggaggtctggtgtatctcatgggagaatctggggtgtctgtaatgtcacccctccagcagcgccacaaggactgaggttgggtaggtgtggggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgataactgagatgggggacgccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcatgtccaccttggaatctggctgaactggctggcaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaacttt

SEQ ID NO: 22644 - DNA, 2244 bp, Homo sapiens
atgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaaataccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgagaaagagactgggcatgcgggagcttctggctcttgttccgcaaagggccactagtagcagggtgaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaa

SEQ ID NO: 22645 - DNA, 5384 bp, Homo sapiens
gggtggtgcagggcaggggtggtatatcctgtctgacggagggcgggcctcgccagtgccagagagggacgaaccagggtggaagcgccaggagcagctgcagggagccctcacgcggaccacgcactctatggccgtagggagccgctgagagcgagaagagcacgctcctgcccgcccgctgcaccgcacctcgcctcgcctctctgctctcctaggccccggccgcgcgccacccgcctcccgccaccatgaaccactcgccgctcaagaccgccttggcgtacgaatgcttccaggaccaggacaactccacgttggctttgccgtcggaccaaaagatgaaaacaggcacgtctggcaggcagcgcgtgcaggagcaggtgatgatgaccgtcaagcggcagaagtccaagtcttcccagtcgtccaccctgagccactccaatcgaggttccatgtatgatggcttggctgacaattacaactatgggaccaccagcaggagcagctactactccaagttccaggcagggaatggctcatggggatatccgatctacaatggaaccctcaagcgggagcctgacaacaggcgcttcagctcctacagccagatggagaactggagccggcactacccccggggcagctgtaacaccaccggcgcaggcagcgacatctgcttcatgcagaaaatcaaggcgagccgcagtgagcccgacctctactgtgacccacggggcaccctgcgcaagggcacgctgggcagcaagggccagaagaccacccagaaccgctacagcttttacagcacctgcagtggtcagaaggccataaagaagtgccctgtgcgcccgccctcttgtgcctccaagcaggaccctgtgtatatcccgcccatctcctgcaacaaggacctgtcctttggccactctagggccagctccaagatctgcagtgaggacatcgagtgcagtgggctgaccatccccaaggctgtgcagtacctgagctcccaggatgagaaataccaggccattggggcctattacatccagcatacctgcttccaggatgaatctgccaagcaacaggtctatcagctgggaggcatctgcaagctggtggacctcctccgcagccccaaccagaacgtccagcaggccgcggcaggggccctgcgcaacctggtgttcaggagcaccaccaacaagctggagacccggaggcagaatgggatccgcgaggcagtcagcctcctgaggagaaccgggaacgccgagatccagaagcagctgactgggctgctctggaacctgtcttccactgacgagctgaaggaggaactcattgccgacgccctgcctgttctggccgaccgcgtcatcattcccttctctggctggtgcgatggcaatagcaacatgtcccgggaagtggtggaccctgaggtcttcttcaatgccacaggctgcttgaggaacctgagctcggccgatgcaggccgccagaccatgcgtaactactcagggctcattgattccctcatggcctatgtccagaactgtgtagcggccagccgctgtgacgacaagtctgtggaaaactgcatgtgtgttctgcacaacctctcctaccgcctggacgccgaggtgcccacccgctaccgccagctggagtataacgcccgcaacgcctacaccgagaagtcctccactggctgcttcagcaacaagagcgacaagatgatgaacaacaactatgactgccccctgcctgaggaagagaccaaccccaagggcagcggctggttgtaccattcagatgccatccgcacctacctgaacctcatgggcaagagcaagaaagatgctaccctggaggcctgtgctggtgccctgcagaacctgacagccagcaaggggctgatgtccagtggcatgagccagttgattgggctgaaggaaaagggcctgccacaaattgcccgcctcctgcaatctggcaactctgatgtggtgcggtccggagcctccctcctgagcaacatgtcccgccaccctctgctgcacagagtgatggggaaccaggtgttcccggaggtgaccaggctcctcaccagccacactggcaataccagcaactccgaagacatcttgtcctcggcctgctacactgtgaggaacctgatggcctcgcagccacaactggccaagcagtacttctccagcagcatgctcaacaacatcatcaacctgtgccgaagcagtgcctcacccaaggccgcagaagctgcccggcttctcctgtctgacatgtggtccagcaaggaactgcagggtgtcctcagacagcaaggtttcgataggaacatgctgggaaccttagctggggccaacagcctcaggaacttcacctcccgattctaagaagagactgtccaagcaagttaggcttgcaggaagatatgacccagctgagaagccctcaggcctcgctggatggggttttctgtccatcctatgcagtatttgggaaagttcacaagaaactgagaagaaacctaaaaactgtggatagtggaaagatttttagattttttttttccttggggaaactggcaggcaatgggggttagggaggttggggcggtgggggctttcttgagttaaaggggcttatatgtgatgtcaatatttcttcctctgagaaatggtatatatatgtgtataatgtaagtgtgtgcatgcatgtgcgcgtgcatgtgtgtgtgtgtgagtgtcttaaagcataaccacaaactgcaaaaagctaggtaagctattttgttgcagctcataaggtggtgaaaaggactctcctgtgtttcttactcataggcaaggacaacatgtgctttttggtgagctgctcataattcctgaaatgtgtggtgccagggcaagggggccatcactgcagtcaggccctcagaggagtcctgcaggcttcctaccagtggtctccaggggtgcaggagtaactggggctgggccagcctccccacttacaaggctgctttccaggaagggaggtctggtgtatctcatgggagaatctggggtgtctgtaatgtcacccctccagcagcgccacaaggactgaggttgggtaggtgtggggttccagaggacagcaggacactctcgcatactttgccaaatgaggcctgctcagaggagtaggagctgaaagatggtgccttccaccctcttgggctgtgtgcccatcagagcaggctcagcctgcaaaggccctgcattcagaggtcttgtaatctacttgttgcaggagaaagaaggtaaaaaatgatttttttaagaaaagctattttattgcagctctttcccaagagctgttctgggaatggctggtcttcatattcccagtggagaggggaacaagtggggctgggcatatacctattccggcttctagtgggatggagttggggtatagaaattaaccaggaagatgtttccaccaagcctgctgtgagtcaattgagggagtgtttggggtcccaggagacttggacggggggagtttgggtagactaggaaaggaaagtgccatatcagggtaccggtaccggcaagctcacatctcagccaggggccatgccccacttcccctgaccccagctgtcttgtctccactctgtgaaacccacaggggatgtgataaacagggctattaggggtatcagccacgtcgagcccccagactctgtgcacttcagaccagcagcagcaggagggctcccgagggccttatgagaaaacctgtgtggacatcccttggtgtacactaagacagagcagagcccagcgctcccaagccttcctccttccagcttctacctccatgctagcattgctggtgttagagaggaattaacttcctggtctgtgcccttctctagaagaatataagatgctcctcctcctcaccccttctcagcctcctcccaagtcttcctcttctgcaccacccccgagtccaaacccacctcttgccccagcattcaggctggaaaacactgatgtggactcagtatgataactgagatgggggacgccagacatgtgaggacgctgtcctccgagaggtgtccccggctgttagccagctgtgctgtggtgctgtgggtctgtcataccctcccttgcttctgttcacactgggaggcccactcctggctcacctctccctctcagggacccacgtgggagcctggatccctggactgtcctgggcataggtttcaggggcctcctttgttgtcatcagaacccagaggaattcttctcctaaaaaatacgtatggcataccaatctgtgcggggcagtgtcctaagcacttagactacatcagggaagaacacagaccacatccctgtcctcatgcggcttatgttttctggaggaaagtggagacacaagtccttggctttagggctcccccggctgggggctgtgcagtccggtcagggcgggaggggaaatgcaccgctgcatgtgaaccttaccagcccaggcggatgccccttccccttagcactaccctggcctcctgcatcccctcgcctcatgttcctcccaccttcaaagaatgaagagccccatgggcccagcccctgccctgggaaccaggcagccttccagacctcaggggctgaggcagactattagggcagggctgactttggtgacactgcccattccctctcaggccagctcaggtcacccgggcctctgacccaggcctgtcactttgagaggggcaaaactgagaggggcttttcctagagaaagagaacaaggagcttgccaggcttcatgtagccgacacacgtctcaggattttaagtccacattggcctcacactaccagggccaatgcccaaaataaggagttccaatttggggccaaatgaggaaggacacagactctgccctgggatctcctgtgctagcggccaatgacaaatccagtcattggccaccagccacctctgcagtggggaccacactagcagccctgactccacactcctcctggggacccaagaggcagtgttgctgtctgcatgtccaccttggaatctggctgaactggctggcaggaccaagactgcggctggggtgggcagggaagggaagccgggggctgctgtgagggatcttggagcttccctgtagcccaccttccccttgcttcatgtttgtagaggaaccttgtgccggccaggcccagtttccttgtgtgatacactaatgtatttgctttttttggaaatagagaaaatcaataaattgctagtgtttctttgaacttt

SEQ ID NO: 22646 - DNA, 4241 bp, Homo sapiens
cagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctctcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaagcaattttttttcaattttaaaagctgaatgaagacaacttaggttgctaacctagttcaaaatgaaattatttagataccaatttttaaaatactggagagaatttatatgtctttttccagagttctgatgataagca

SEQ ID NO: 22647 - DNA, 4302 bp, Homo sapiens
ggggccggactcgagcggggcggggctcgcgccagcgcccccagctccgtggcggcttcgcccgcgagtccagaggcaggcgagcagctcggtcgcccccaccggccccatggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacaggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaacaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactgaggaaaatgacaaagtattctcggctgcaaaaatccccaaaggaaaacacctatttttctactacccagcccaagaaacctcaaaagcatgccttgtttctatccttctctatttccgtggtcccctgaatccagaaaacaaatagaacataattttatgagtcttccagaagacctttgcaagtttgccaccagtagataccggccacaggctcgacaaatagtggtctttgttattagggcttatggtacatggcttcctggaatcaaaatgtgaattcatgtggaagggacattaatccaataaataaggaaagaagctgttgcattactgggattttaaaagtttgatttacatttatattccttttctggttcccatgttttgtcactcatgtgcacattgcttcgccattgggcctccagtgtattgttctgcagtgttgaaacagaatggaaatgacaagaaatatctgcagttatccaggagaaagtataatggcaaaattattggtttctttctttactttgtgcttgtttttatccccttgggttgtttttctctgatttttaaataaacttaagaaatttagattacagagtatgcatgactgtaagaaaaagaaattgagaggaagtgatcatagcaaattaaagaagtcttttcctcccagaacttaaagtaaaataaaaaataaataaataaataaaatcttttccacagagaaaggcaactgtgatgataaaatttaacgttcccccaaacactgagtcaatgagatttttctcaggagatactttacctataacaacgccgttaaatccaaatctcttctaaacgatggcattctatgtaatgcctttcctggacttttttggccactgccctggactagtgaaagaatggactctatctttatctgcaagaggaactaaggccttctctcagactgcctggccagcctggggcactgaaaatacggctcatgttaatgagttacattatcagccagcccagccttgcccaccatttaagaaatatcacagagccactagatctcatatgatcttcttcaagccattattttaactcaagaaaactctagagaagaaaagtgaagaagtcatgttgaagaagatgtaagaatgtgtcaagaccatccagaaatgatatgagaaatactgatattttaaatggttgacatcatccagcgaaatgaatctacattaaatgttgttttaactgcgctatgattaaaaccattcatatagagttagtctttacaactactattctgttatttttttttttaatctgacaacatttgtcctaagtaagataagcaaaaaaattcttcaactccttttggcaagaaaactgtaacagaaaataaattttgaatgtgtacttaagtctttattatatttgaagcaattttttttcaattttaaaagctgaatgaagacaacttaggttgctaacctagttcaaaatgaaattatttagataccaatttttaaaatactggagagaatttatatgtctttttccagagttctgatgataagcatttggagtgcatttattcctccagataataaatgtgtgttcagaactttttgtgttttttaaggcattaataaagccttcgataatattaaatacaaaatgagaccaaa

SEQ ID NO: 22648 - DNA, 2644 bp, Homo sapiens
atggcagcccccggcgccccagctgagtacggctacatccggaccgtcctgggccagcagatcctgggacaactggacagctccagcctggcgctgccctccgaggccaagctgaagctggcggggagcagcggccgcggcggccagacagtcaagagcctgcggatccaggagcaggtgcagcagaccctcgcccggaagggccgcagctccgtgggcaacggaaatcttcaccgaaccagcagtgttcctgagtatgtctacaacctacacttggttgaaaatgattttgttggaggccgttcccctgttcctaaaacctatgacatgctaaaggctggcacaactgccacttatgaaggtcgctggggaagaggaacagcacagtacagctcccagaagtccgtggaagaaaggtccttgaggcatcctctgaggagactggagatttctcctgacagcagcccggagagggctcactacacgcacagcgattaccagtacagccagagaagccaggctgggcacaccctgcaccaccaagaaagcaggcgggccgccctcctagtgccaccgagatatgctcgttccgagatcgtgggggtcagccgtgctggcaccacaagcaggcagcgccactttgacacataccacagacagtaccagcatggctctgttagcgacaccgtttttgacagcatccctgccaacccggccctgctcacgtaccccaggccagggaccagccgcagcatgggcaacctcttggagaaggagaactacctgacggcagggctcactgtcgggcaggtcaggccgctggtgcccctgcagcccgtcactcagaacagggcttccaggtcctcctggcatcagagctccttccacagcacccgcacgctgagggaagctgggcccagtgtcgccgtggattccagcgggaggagagcgcacttgactgtcggccaggcggccgcagggggaagtgggaatctgctcactgagagaagcactttcactgactcccagctggggaatgcagacatggagatgactctggagcgagcagtgagtatgctcgaggcagaccacatgctgccatccaggatttctgctgcagctactttcatacagcacgagtgcttccagaaatctgaagctcggaagagggttaaccagcttcgtggcatcctcaagcttctgcagctcctaaaagttcagaatgaagacgttcagcgagctgtgtgtggggccttgagaaacttagtatttgaagacaatgacaacaaattggaggtggctgaactaaatggggtacctcggctgctccaggtgctgaagcaaaccagagacttggagactaaaaaacaaataacagaccatacagtcaatttaagaagtaggaatggctggccgggcgcggtggctcacgcctgtaatcccagcactttgggaggccaaggcgggcggatcacgaggtcaggagttcgagaccagcctgaccaacatggtttgctgtggaatttgtcatctaatgacaaactcaagaatctcatgataacagaagcattgcttacgctgacggagaatatcatcatccccttttctgggtggcctgaaggagactacccaaaagcaaatggtttgctcgattttgacatattctacaacgtcactggatgcctaagaaacatgagttctgctggcgctgatgggagaaaagcgatgagaagatgtgacggactcattgactcactggtccattatgtcagaggaaccattgcagattaccagccagatgacaaggccacggagaattgtgtgtgcattcttcataacctctcctaccagctggaggcagagctcccagagaaatattcccagaatatctatattcaaaaccggaatatccagactgacaacaacaaaagtattggatgttttggcagtcgaagcaggaaagtaaaagagcaataccaggacgtgccgatgccggaggaaaagagcaaccccaagggcgtggagtggctgtggcattccattgttataaggatgtatctgtccttgatcgccaaaagtgtccgcaactacacacaagaagcatccttaggagctctgcagaacctcacggccggaagtggaccaatgccgacatcagtggctcagacagttgtccagaaggaaagtggcctgcagcacacccgaaagatgctgcatgttggtgacccaagtgtgaaaaagacagccatctcgctgctgaggaatctgtcccggaatctttctctgcagaatgaaattgccaaagaaactctccctgatttggtttccatcattcctgacacagtcccgagtactgaccttctcattgaaactacagcctctgcctgttacacattgaacaacataatccaaaacagttaccagaatgcacgcgaccttctaaaccgggggcatccagaaaattatggccattagtgcaggcgatgcctatgcctccaacaaagcaagtaaagctgcttccgtccttctgtattctctgtgggcacacacggaactgcatcatgcctacaagaaggctcagtttaagaagacagattttgtcaacagccggactgccaaagcctaccactcccttaaagactga

SEQ ID NO: 22649 - DNA, 2809 bp, Homo sapiens
ggcctcgagggacaggacgtgaagatagttgggtttggaggcggccgccaggcccaggcccggtggacctgccgccatgcaggacggtaacttcctgctgtcggccctgcagcctgaggccggcgtgtgctccctggcgctgccctctgacctgcagctggaccgccggggcgccgaggggccggaggccgagcggctgcgggcagcccgcgtccaggagcaggtccgcgcccgcctcttgcagctgggacagcagccgcggcacaacggggccgctgagcccgagcctgaggccgagactgccagaggcacatccagggggcagtaccacaccctgcaggctggcttcagctctcgctctcagggcctgagtggggacaagacctcgggcttccggcccatcgccaagccggcctacagcccagcctcctggtcctcccgctccgccgtggatctgagctgcagtcggaggctgagttcagcccacaacgggggcagcgcctttggggccgctgggtacgggggtgcccagcccacccctcccatgcccaccaggcccgtgtccttccatgagcgcggtggggttgggagccgggccgactatgacacactctccctgcgctcgctgcggctggggcccgggggcctggacgaccgctacagcctggtgtctgagcagctggagcccgcggccacctccacctacagggcctttgcgtacgagcgccaggccagctccagctccagccgggcaggggggctggactggcccgaggccactgaggtttccccgagccggaccatccgtgcccctgccgtgcggaccctgcagcgattccagagcagccaccggagccgcggggtaggcggggcagtgccgggggccgtcctggagccagtggctcgagcgccatctgtgcgcagcctcagcctcagcctggctgactcgggccacctgccggacgtgcatgggttcaacagctacggtagccaccgaaccctgcagagactcagcagcggttttgatgacattgacctgccctcagcagtcaagtacctcatggcttcagaccccaacctgcaggtgctgggagcggcctacatccagcacaagtgctacagcgatgcagccgccaagaagcaggcccgcagccttcaggccgtgcctaggctggtgaagctcttcaaccacgccaaccaggaagtgcagcgccatgccacaggtgccatgcgcaacctcatctacgacaacgctgacaacaagctggccctggtggaggagaacgggatcttcgagctgctgcggacactgcgggagcaggatgatgagcttcgcaaaaatgtcacagggatcctgtggaacctttcatccagcgaccacctgaaggaccgcctggccagagacacgctggagcagctcacagacctggtgttgagccccctgtcgggggctgggggtccccccctcatccagcagaacgcctcggaggcagagatcttctacaacgccaccggcttcctcaggaacctcagctcagcctctcaggccactcgccagaagatgcgggagtgccacgggctggtggacgccctggtcacctctatcaaccacgccctggacgcgggcaaatgcgaggacaagagcgtggagaacgcggtgtgcgtcctgcggaacctgtcctaccgcctctacgacgagatgccgccgtccgcgctgcagcggctggagggtcgcggccgcagggacctggcgggggcgccgccgggagaggtcgtgggctgcttcacgccgcagagccggcggctgcgcgagctgcccctcgccgccgatgcgctcaccttcgcggaggtgtccaaggaccccaagggcctcgagtggctgtggagcccccagatcgtggggctgtacaaccggctgctgcagcgctgcgagctcaaccggcacacgacggaggcggccgccggggcgctgcagaacatcacggcaggcgaccgcaggtgggcgggggtgctgagccgcctggccctggagcaggagcgtattctgaaccccctgctagaccgtgtcaggaccgccgaccaccaccagctgcgctcactgactggcctcatccgaaacctgtctcggaacgctaggaacaaggacgagatgtccacgaaggtggtgagccacctgatcgagaagctgccgggcagcgtgggtgagaagtcgcccccagccgaggtgctggtcaacatcatagctgtgctcaacaacctggtggtggccagccccatcgctgcccgagacctgctgtattttgacggactccgaaagctcatcttcatcaagaagaagcgggacagccccgacagtgagaagtcctcccgggcagcatccagcctcctggccaacctgtggcagtacaacaagctccaccgtgacttccgggcgaagggctatcggaaggaggacttcctgggcccataggtgaagccttctggaggagaaggtgacgtggcccagcgtccaagggacagactcagctccaggctgcttggcagcccagcctggaggagaaggctaatgacggaggggcccctcgctggggcccctgtgtgcatctttgagggtcctgggccaccaggaggggcagggtcttatagctggggacttggcttccgcagggcagggggtggggcagggctcaaggctgctctggtgtatggggtggtgacccagtcacattggcagaggtgggggttggctgtggcctggcagtatcttgggatagccagcactgggaataaagatggccatgaacagtca

SEQ ID NO: 22650 - DNA, 823 bp, Homo sapiens
acagcattcagaaggaccccaggcgaggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctggggg

SEQ ID NO: 22651 - DNA, 5777 bp, Homo sapiens
ggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcaggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcattcataggacacttcactgccattttctattcacataaaagaaaaataaatgtggaaatttcatccttggaaatgtgttctctattctttttaaattttctgtatgtatatggaaaagcagatttaataaacacaaatctaactgcatgttggaaacagcttaaatatatccaactattttggacttttcctagttttatatatactttgtgagatggaccacaccaaagaattaagctatgaactttccttctctgacaatctaggtatttttatttcttggaatctatttcaaatctagtacccttcacagttttatcatgtttttctatatggcagcccggccataactaaattgatataactaaattgataccttttttaggcatcatttttaagaactcagtaacttcataagaacagtggttgggcatttatttggttggcaccaatataataaaacaaattctaaattatgatcttgttgagtaattcctggattaggaatggggtaggggaaagaagccccacagtagggtaggcagaggtccccatagcaccacacagcattacttgggagcttttctccatctgtggaggcaatgagggacaccaggcccaaagtctgaggccttctcaggtcttgcagtttccacccttcagtcctagctcctggatctttgttggtgtaaatatggaaatgccacattggttaagtgccatcatggaaaactaggaactagtttacctgtagctgtactaggaaaactaggaactaacgcccatggcaagtcaaacccagaagtgttgtcttagctcaatataccctgcaagtgtaatacaaatcgcagattaaaacatttgtacttatatttgtgagtatatggaaagacacccaagagaaaactgcgttttcttgccgaatggacagcagcccaagatgagcatccaaagtgaaatggaaataccagtgcgagcatgaaagttcctaagatctgcaagccgggagcccttctggggtgccttctgaagaacactcgagccagcttgcggagtcgactgcccagctactgagccctggctgcctcatacctggcggagctcagcagacagcccttgttagatggcagaggtcgccagatgttcctgaggaactggcatcaggacttctgggacgtaaccacttcagtttccaatcactgacttccctgaacctggtatcttcagatctgggttgaagctgaaggctcagttggggaatcaggaaaacaagggaatcggagccagcccaagccaactgacaataactttcttttagtgactgcattagtttggggtaatgctgtaacaggcagcatttcaaaaacggatccaaatttgggttgaaaataactcacctgggtctccaatcagacctaacagagccagaaagaggcctgtacacggggactgggcagaagatctaatgccgtttaagactcctcccttgagaccagagaaaagaaactgcagacacagcctga

SEQ ID NO: 22652 - DNA, 4443 bp, Homo sapiens
gcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacaggcttacggagttcctatgctagtcagcatagtcagcttgggcaagaccttcgttctgccgtgtctcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgtcctatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcattcataggacacttcactgccattttctattcacataaaagaaaaataaatgtggaaatttcatccttggaaa

SEQ ID NO: 22653 - DNA, 4581 bp, Homo sapiens
tccggggctgagtccgcgtcgacgccggccgcggaggcggcaccatgggcaaggggtagaggggcaagttggccaccgccgccgccgggggtggtgggagagccgctccgggggcgggggccggtgggggagggaggggcgggcagccgcgccgccgcggcacttttttaattttttcgggtgccgcagcggcgacccctcggcgccgatgtccctgatccctggagcgacgacggccgctgcctaagctggaaagaggaatgccagctcctgagcaggcctcattggtggaggaggggcaaccacagacccgccaggaagctgcctccactggcccaggcatggaacccgagaccacagccaccactattctagcatccgtgaaggagcaggagcttcagtttcagcgactcacccgagaactggaagtggaaaggcagattgttgccagtcagctagaaagatgtaggcttggagcagaatcaccaagcatcgccagcaccagctcaactgagaagtcatttccttggagatcaacagacgtgccaaatactggtgtaagcaaacctagagtttctgacgctgtccagcccaacaactatctcatcaggacagagccagaacaaggaaccctctattcaccagaacagacatctctccatgaaagtgagggatcattgggtaactcaagaagttcaacacaaatgaattcttattccgacagtggataccaggaagcagggagtttccacaacagccagaacgtgagcaaggcagacaacagacagcagcattcattcataggatcaactaacaaccatgtggtgaggaattcaagagctgaaggacaaacactggttcagccatcagtagccaatcgggccatgagaagagttagttcagttccatctagagcacagtctccttcttatgttatcagcacaggcgtgtctccttcaagggggtctctgagaacttctctgggtagtggatttggctctccgtcagtgaccgacccccgacctctgaaccccagtgcatattcctccaccacattacctgctgcacgggcagcctctccgtactcacagagacccgcctccccaacagctatacggcggattgggtcagtcacctcccggcagacctccaatcccaacggaccaacccctcaataccaaaccaccgccagagtggggtccccactgaccctgacggatgcacagactcgagtagcttccccatcccaaggccaggtggggtcgtcgtcccccaaacgctcagggatgaccgccgtaccacagcatctgggaccttcactgcaaaggactgttcatgacatggagcaattcggacagcagcagtatgacatttatgagaggatggttccacccaggccagacagcctgacagcttacggagttcctatgctagtcagcatagtcagcttgggcaagaccttcgttctgccgtgtcccgacttgcacattactcctatatatgaggggaggacctattacagcccagtgtaccgcagcccaaaccatggaactgtggagctccaaggatcgcagacggcgttgtatcgcacaggttcagtaggtattggaaatctacaaaggacatccagccaacgaagtacccttacataccaaagaaataattatgctctgaacacaacagctacctacgcggagccctacaggcctatacaataccgagtgcaagagtgcaattataacaggcttcagcatgcagtgccggctgatgatggcaccacaagatccccatcaatagacagcattcagaaggaccccagggagtttgcctggcgtgatcctgagttgcctgaggtcattcacatgcttcagcaccagttcccatctgttcaggcaaatgcagcggcctacctgcagcacctgtgctttggtgacaacaaagtgaagatggaggtgtgtaggttagggggaatcaagcatctggttgaccttctggaccacagagttttggaagttcagaagaatgcttgtggtgcccttcgaaacctcgtttttggcaagtctacagatgaaaataaaatagcaatgaagaatgttggtgggatacctgccttgttgcgactgttgagaaaatctattgatgcagaagtaagggagcttgttacaggagttctttggaatttatcctcatgtgatgctgtaaaaatgacaatcattcgagatgctctctcaaccttaacaaacactgtgattgttccacattctggatggaataactcttcttttgatgatgatcataaaattaaatttcagacttcactagttctgcgtaacacgacaggttgcctaaggaacctcagctccgcgggggaagaagctcggaagcaaatgcggtcctgcgaggggctggtagactcactgttgtatgtgatccacacgtgtgtgaacacatccgattacgacagcaagacggtggagaactgcgtgtgcaccctgaggaacctgatcggctggagctggaggtgccccaggcccggttactgggactgaacgaattggatgacttactaggaaaagagtctcccagcaaagactctgagccaagttgctgggggaagaagaagaaaaagaaaaagaggactccgcaagaagatcaatgggatggagttggtcctatcccaggactgtcgaagtcccccaaaggggttgagatgctgtggcacccatcggtggtaaaaccatatctgactcttctagcagaaagttccaacccagccaccttggaaggctctgcagggtctctccagaacctctctgctggcaactggaagtttgcagcatatatccgggcggccgtccgaaaagaaaaggggctccccatccttgtggagcttctgagaatggataacgatagagttgtttcttccgtggcaacagccttgaggaatatggcactagatgttcgcaacaaggagctcataggcaaatacgccatgcgagacctggtcaaccggctccccggcggcaatggccccagtgtcttgtctgatgagaccatggcagccatctgctgtgctctgcacgaggtcaccagcaaaaacatggagaacgcaaaagccctggccgactcaggaggcatagagaagctggtgaacataaccaaaggcaggggcgacagatcatctctgaaagtggtgaaggcagcagcccaggtcttgaatacattatggcaatatcgggacctccggagcatttataaaaaggatgggtggaatcagaaccattttattacacctgtgtcgacattggagcgagaccgattcaaatcacatccttccttgtctaccaccaaccaacagatgtcacccatcattcagtcagtcggcagcacctcttcctcaccagcactgttaggaatcagagaccctcgctctgaatacgataggacccagccacctatgcagtattacaatagccaaggggatgccacacataaaggcctgtaccctggctccagcaaaccttcaccaatttacatcagttcctattcctcaccagcaagagaacaaaatagacggctacagcatcaacagctgtattatagtcaagatgactccaacagaaagaactttgatgcatacagattgtatttgcagtctcctcatagctatgaagatccttattttgatgaccgagttcactttccagcttctactgattactcaacacagtatggactgaaatcgaccacaaattatgtagacttttattccactaaacgaccttcttatagagcagaacagtacccagggtccccagactcatgggtgtagcatcaagatgcccaacagaggaactctttctttctaaccttgttcagattgaggtgaaaagtccatcttgctgatttgatgattgaaatgtgaaagtgaagtggaaggaatgaatgaagtgtgttttttttttcttttttgaggaattatcagggaagtgaggaaatgtttgggagaggactttctaagctctatttaggtgttagatctaattacttatagattctgtagtctggtgaaggtgtgggtgacgtgatgagaggtttgagaaatgggtgaaatgaaatgggggatatgtaggtcaaatcaaattaaagatgatttttttaatgtgaataaagttatgttctgatagtttgtacagaaaaaataaaatggatgcccatgttttattgctattactaaatgtcaagattgtatgctattatgtcttgtaaatttcttttgttggtgtaaatatggaaatgccacattggttaagtgccatcatttgtaatgcaatgtgtcacttgaaaagagatttgaagaaactgacaacttcaaaaacaaatgagaagcccaaggaactgtgagcaattaaaagcaaaccgcgacaccctttgtctccaccacacatagtgtactttggaagcacaacgtccaggctggtaccgcagcgccatgcccattcctcgcctcattcataggacacttcactgccattttctattcacataaaagaaaaataaatgtggaaatttcatccttgg

SEQ ID NO: 22654 - DNA, 2287 bp, Homo sapiens
gcaggcctggtggtgagcagggacggtgcaccggacggcgggatcgagcaaatgggtctggccatggagcacggagggtcctacgctcgggcggggggcagctctcggggctgctggtattacctgcgctacttcttcctcttcgtctccctcatccaattcctcatcatcctggggctcgtgctcttcatggtctatggcaacgtgcacgtgagcacagagtccaacctgcaggccaccgagcgccgagccgagggcctatacagtcagctcctagggctcacggcctcccagtccaacttgaccaaggagctcaacttcaccacccgcgccaaggatgccatcatgcagatgtggctgaatgctcgccgcgacctggaccgcatcaatgccagcttccgccagtgccagggtgaccgggtcatctacacgaacaatcagaggtacatggctgccatcatcttgagtgagaagcaatgcagagatcaattcaaggacatgaacaagagctgcgatgccttgctcttcatgctgaatcagaaggtgaagacgctggaggtggagatagccaaggagaagaccatttgcactaaggataaggaaagcgtgctgctgaacaaacgcgtggcggaggaacagctggttgaatgcgtgaaaacccgggagctgcagcaccaagagcgccagctggccaaggagcaactgcaaaaggtgcaagccctctgcctgcccctggacaaggacaagtttgagatggaccttcgtaacctgtggagggactccattatcccacgcagcctggacaacctgggttacaacctctaccatcccctgggctcggaattggcctccatccgcagagcctgcgaccacatgcccagcctcatgagctccaaggtggaggagctggcccggagcctccgggcggatatcgaacgcgtggcccgcgagaactcagacctccaacgccagaagctggaagcccagcagggcctgcgggccagtcaggaggcgaaacagaaggtggagaaggaggctcaggcccgggaggccaagctccaagctgaatgctcccggcagacccagctagcgctggaggagaaggcggtgctgcggaaggaacgagacaacctggccaaggagctggaagagaagaagagggaggcggagcagctcaggatggagctggccatcagaaactcagccctggacacctgcatcaagaccaagtcgcagccgatgatgccagtgtcaaggcccatgggccctgtccccaacccccagcccatcgacccagctagcctggaggagttcaagaggaagatcctggagtcccagaggccccctgcaggcatccctgtagccccatccagtggctgaggaggctccaggcctgaggaccaagggatggcccgactcggcggtttgcggaggatgcagggatatgctcacagcgcccgacacaaccccctcccgccgcccccaaccacccagggccaccatcagacaactccctgcatgcaaacccctagtaccctctcacacccgcacccgcgcctcacgatccctcacccagagcacacggccgcggagatgacgtcacgcaagcaacggcgctgacgtcacatatcaccgtggtgatggcgtcacgtggccatgtagacgtcacgaagagatatagcgatggcgtcgtgcagatgcagcacgtcgcacacagacatggggaacttggcatgacgtcacaccgagatgcagcaacgacgtcacgggccatgtcgacgtcacacatattaatgtcacacagacgcggcgatggcatcacacagacggtgatgatgtcacacacagacacagtgacaacacacaccatgacaacgacacctatagatatggcaccaacatcacatgcacgcatgccctttcacacacactttctacccaattctcacctagtgtcacgttcccccgaccctggcacacgggccaaggtacccacaggatcccatcccctcccgcacagccctgggccccagcacctcccctcctccagcctcctggcctcccagccacttcctcacccccagtgcctggacccggaggtgagaacaggaagccattcacctccgctccttgagcgtgagtgtttccaggaccccctcggggccctgagccgggggtgagggtcacctgttgtcgggaggggagccactccttctcccccaactcccagccctgcctgtggcccgttgaaatgttggtggcacttaataaatattagtaaatcctt

SEQ ID NO: 22655 - DNA, 1169 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcaaacctaggtcagacttttcctttcatctttgtgttcatctactgtaaagtgtccgtctgtgtctgtgagggattggttccaggacccctgtggctaccaaaatccatgcttctcaagtcccttatgtaaaatggtgcagtatttgcatataacctacataccttctcttgtgcaatccctaatataatgtaaatgctatgtaatcgttgttatactgtattgtttttatttgtattatgttttattgtcatattgttattttctctcatctttttcaagtcttttccatccacagttggttgaatttgtggatgtggaacccatggatacagagggccaactgtatttaggataatttcatcacttttaattcaaaccagaatatgtgaataagcagacagaaagaatctttttgatgtcgatgttcaactatttttggcaccatagtagaacatggttgctttctattttttcttgggtatggaggtttcttgaagacctagaacatagaagaatgcctagttaaaaaaaaaaatcaatgaaactacgagttttaggccaaatctgagaaaagaccaaagatgactatgtttgggactgaagtaaacatatcaagttagaactctcatcacatgtttgactcaaattgtggagcaaaatagtaaataaaatataaaaatgaaaatgaagatacgtgaaa

SEQ ID NO: 22656 - DNA, 960 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaaggctgcaatcaagatgttggcatggctggggtctcatctgaaggctggactggagaagaatctacttccaaacttatgtggtagttggaagaatttagttcctcaaggctgctaaactgatggcctgtgttccttgcctctgggatggtagcttgcttcaacaaagtgtgcaagcagagaagacagagagagtccgctagcaagatagaagccacaatctcttgtaatctatcatttttgctgtattctactggttaaaaataactcattaggttagcctactggctctcagggggaagagattatacaaaggcatgaatttctggaggagggaatgagggcaaagaactctgaaaagtttctcttccacaatctgaagaacttctagaaagtagaaggaagcaatattgcttagggatggacaacttggcactggttatgtgttccaagtgaggtaaccttgttcccaggaataaagagaaccagatgactgtaaacatttccctaaactgaaatgcactgttgtatgttcacctgaaatgaatggtgtaagctgaatatgagatttttgacaaaataaaaattttgctgtgttctca

SEQ ID NO: 22657 - DNA, 553 bp, Homo sapiens
actctcatgtaagtcaacaacatcctgggattgggacacactttctgggcactgctggccagtcccaaaatggaacataaggaagtggttcttctacttcttttatttctgaaatcaggtcaaggagagcccctggatgactatgtgaatacccaggggccttcactgttcagtgtcactaagaagcagctgggggcaggaagcagagaagaatgtgcagcaaaatgtgaagaggacaaagaattcacctgcagggcattccaatatcacagtaaagagcaacaatgtgtgataatggctgaaaacaggaagtcctccataatcattaggatgagagatgcagttttatttgaaaagtaaatgtatctttcagagtgcaagactgggaatggaaagaactacagagggacgatgtccaaaacaaaaaatggcatcacctgtcaaaaatggagttccacttctccccgcaaacctagattctcacctgctacacacccctcagagggactggaggaatccagacaacgatgcgcaggggccctggtgctatact

SEQ ID NO: 22658 - DNA, 1512 bp, Homo sapiens
caggctcccagccccgacgcctcctgcagcgcctggagccacacagggatccggagcctgggggaaaagcggcgcgggagccggcacccaccgctggaggggcggcgacggcggccgtagcgacctcgggaggcaagcggagccgccatggccgagttcccgtcgaaagttagcacgcggaccagcagtcctgcgcagggcgccgaagcctcggtgtcggcgctgcgcccggacctgggcttcgtgcgctcccgcctcggggcgctcatgctgctgcagctggtgctggggctgctggtgtgggcgctgattgcggacaccccgtaccacctgtatccggcctatggctgggtgatgttcgtcgctgtcttcctctggctggtgacaatcgtcctcttcaacctctacctgtttcagctgcacatgaagttgtacatggttccctggccactggtgttaatgatctttaacatcagcgccaccgttctctacatcaccgccttcatcgcctgctctgcggcagttgacctgacatccctgaggggcacccggccttataaccagcgcgcggctgcctcgttctttgcgtgtttggtgatgatcgcctatggagtgagtgccttcttcagctaccaggcctggcgaggagtaggcagcaatgcggccaccagtcagatggctggcggctatgcctaaaccacctgtgccacggccccctctggggctgaagccgccgctgggtcacagagcagggtcaccctgcaagcctgaagctggggagccctgcgtggagtcagcccaacagggactgcatttgctcctctctgcccgtcagacataagctctcacagcgctaaggaagcaggcccaggctggcaggcatctcggcttgcaggaggccaactgctgagacctcttctccatcccccttattcagtggaagatgacgggggatctgaggctgtgtctctgccttgtctttagaggacttcagcgtccaagactggggcccacccttctcaccagcactaaatgcactaacaaggactccagacctgcagccccagacccgccgtagtataagcctaacaagcaacacgtagcaccttagtctttgttccaggagagctgagcaagctggtgaaaccactctccttcctttaaacaccgtttcaaccaacctctccctggagccaacctgtaaaaagtgggttgattgctgacagcatggtcttccctccctgcatttcagacataccagttactgaaagcaaatcagttttaagtgatttctcagtgctgaaaagcctgtccaggtttccttccctttcccaagcctctctctgtaatactccctttgggcgaagctaacatcggtgcctccccgaccttgctgactaggcacatgggacgcaaaggagggagggaagcaaggccttgcctggcgagttgtcatgtggttggtggtgactgttttattttttttaataaaaataaagatgagagaaatta

SEQ ID NO: 22659 - DNA, 3755 bp, Homo sapiens
atcaagattaatatctgtagtaataggcagaacacttcagtgtggaattgcttcttttctttggtcaaacactaactttggcagaggatagacacagcttaggaagactgaattttaagtcttctgaattgtttttctggacttccaaatctcaagtgataagaccagcagaagcagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaagggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatat

SEQ ID NO: 22660 - DNA, 3706 bp, Homo sapiens
atgcgcagtggcgcgagcgcagcggctacgcgggcgcggagaggtagccgcagagtggacctgcaggtacttggatctccagtgggagctgccctctcgaaggcaggacagcggtggcggcagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaagggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcacagtttacaggattctgaaatgtagtgggtgtaaaaccagagattatttgtatgctcaaaatagttatatattcattaatgaattcaatatcctgttcatactagttagagctggtcagcctttttgggtaacacagttaatttaccaactgatacagataatagaatatattcataatcaagctgatacttcatgattaaattatttttgttgcttaaaagtcgtattagacaagactaaatcattcttttttatggttcaaaaaagatgaatacaaacgtttttgcaggttctgctgtgaaatgtggtttgatttttttggtgtgttaattttgatcataaatgcattcatactcataatccagtttaatccttttatttgcttcctccaactatttaaagtggtccaaaaacacttttctgtaagtttctatactgtctaaaaccttatggtgaccagaattgtttattaatatcaaacttttttatatatgagaactaattcttgaataaaccccaaagttcactctcttgtttaagtagcagcagctttttacttaaaatttaattttaactacattgatactttacacatcctagtttggtaacacagctttaactatgtcatgcaacatatatatgttggtaggatgttattagagagatatgtgtgcatatatatttttttgcacctgaatcacccagcttttcataagtggtatgtttaattggtcattcagccaaccatcagtattttccccccacaacatgtgtaacacttttcagtctgtggatatctgatacattaagatttctttttataagtattcattttgaatgtgcatatagttatttgaccccttccaaatacttgtagccaaacattggctagaacatcccaagatatgctgacactgtcctgttagcttcatattatacttgctagtttaggtctctatagaagccctatataatttagaatatgcccactgaatatctttaatagaaagtaacataaagctagtattcaatgtagagtattttcatatgtttttcacagcccgttacaaattggcaatgtttggttaatgtttgtattacttggaaatcgctacagcttggactatttttttctaaatttttagcattagtccatttctgctgctaacaattgaatccagaaatctactttctccatcttccactgttagtgccagtgagcaatactgttgtgcaacaaaaatgtcactttatctcagtgtgaatgagtagtctaaattccctttctaccattgatttaaatatatatattggtaagagagactgcccatgtgtttagaatagaattttttaaatgaaatgatcaacaggtggaatttgaaatatattcttctacaaaagagatttctttcccttttatattttgatgattgttttcttaagattaagatatgttcttgctcttttataagattatttaaattatgtttccctctgattttttttcaccattgtatttactaagttattggatttacatgaaatctggcactttagggtgttctttttctcacagagtatatttaataaaaatgctgtgtatatagaaa

SEQ ID NO: 22661 - DNA, 567 bp, Homo sapiens
agtggacctgcaggtacttggatctccagtgggagctgccctctcgaaggcaggacagcggtggcggcagccacggtgttggatacacttgtatgaggcttcagctgtgctgcataaatttcttgaagaacctgtgagccagaagcaaaatttcaggacagggggcacacactgaacttgaagaaacattttccaagatgctaaaagtatggcttctactcatttttcccaaaaactgaagtaaaatgctaaaaagaatccatgtcatctgccagatttccaaaggctgtttttgagttcttctctaagatgttttcctccataaatgtgtacagcattaaagaagcccctgcagcatcttggagataatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgaga

SEQ ID NO: 22662 - DNA, 564 bp, Homo sapiens
acttggatctccagtgggagctgccctctcgaaggcaggacagcggtggcggcagccacggtgttggatacacttgtatgaggcttcagctgtgctgcataaatttcttgaagaacctgtgagccagaagcaaaatttcaggacagggggcacacactgaacttgaaatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttatt

SEQ ID NO: 22663 - DNA, 580 bp, Homo sapiens
gggcgcggagaggtagccgcagagtggacctgcaggtacttggatctccagtgggagctgccctctcgaaggcaggacagcggtggcggcagagacagagtctccctgtgttgcccaggctggtcttgaactcctggcctcaagcaatccacctgccttggcctcccaaagtgctgcaattacagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattctta

SEQ ID NO: 22664 - DNA, 608 bp, Homo sapiens
gcgggcgcggagaggtagccgcagagtggacctgcaggtacttggatctccagtgggagctgccctctcgaaggcaggacagcggtggcggcagagacagagtctccctgtgttgcccaggctggtcttgaactcctggcctcaagcaatccacctgccttggcctcccaaagtgctgcaattacagggaaggccagcgttggattgtgtaggttgcaaaatgcagtacctcagacttgcaactctgaaaagcactgtttgaaatctctgtaaagagtgaaaaacttcaagttttaaccaatgagtgttttagaggttaaagtttaaactctgacttggaagcacgctgggtaggactcctctgctcactcagactcaagttggatcatcagaatctctcttgtgttgctgtgaatgatttgcattgaaattcccagctagaactggaggaaagaggattacaaaccaggagatataaagacctgaagatagtcttttctgtccaaagatggaaaacagtactactaccatttctcgggaggagcttgaagaactacaagaggcatttaataaaatagatattgacaatagtgggtatgtcagtgact

SEQ ID NO: 22665 - DNA, 574 bp, Homo sapiens
agccgcagagtggacctgcaggtacttggatctccagtgggagctgccctctcgaaggcaggacagcggtggcggcagggaaggccagcgttggattgtgtaggttgcaaaatgcagtacctcagacttgcaactctgaaaagcactgtttgaaatctctgtaaagagtgaaaaacttcaagttttaaccaatgagtgttttagaggttaaagtttaaactctgacttggaagcacgctgggtaggactcctctgctcactcagactcaagttggatcatcagaatctctcttgtgttgctgtgaatgatttgcattgaaattcccagctagaactggaggaaagaggattacaaaccaggagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaa

SEQ ID NO: 22666 - DNA, 2258 bp, Homo sapiens
aattctccataggaacactatcaagtctttttccataaaagtcagataaaagaaagatcacatttcttgatattctttgaagcaactttatttttattgtcatgcttcatcctgcccgaatactgccaagtctttctcaggcacctggaatctgctcctcagcctctgttgtcctgggtctaatgtagagcaaaaggctgagaggaagctcttctattctccatcatcggtcttcagtggctacctgggaaacaccccttggcttagtcggcagattctctccgatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcgcgagattgtggagaaaattctatcagttgctgacagcaacaaagatggcaaaatcagttttgaagagtttgtgtcactaatgcaagaattaaaaagcaaagatatcagcaaaacattccgaaaaataattaacaagagggaagggattactgctattggaggaacttcaactatttccagtgagggcacacagcattcttattcagaggaagaaaaagtggcttttgttaactggataaacaaagccctggagaatgaccctgactgtaagcatcttatacccatgaatcccaatgatgatagtcttttcaagtcacttgcagatggcatccttctttgcaaaatgatcaacttatctgaaccagatacaattgatgaaagagccatcaataagaaaaagctcacgccattcactatttctgaaaatttaaacctagctctgaattctgcctcagccattggttgtacagtggtcaacattggtgcatcagatctcaaagaaggaaaacctcacttggtcttgggacttctctggcagatcatcaaagttggcctttttgctgatattgagatttccaggaatgaagctctgattgcattgttaaatgaaggtgaggaactagaggagctgatgaagctttctcccgaggaattactgctgcgatgggtgaactaccatctgaccaatgcaggatggcataccatcagcaacttcagccaagacattaaggactcgagagcctattttcatctgcttaatcagattgcccctaaaggtggggaagatggacctgccattgccattgacctttcaggaattaatgagacaaatgacctgaagcgtgctggactcatgcttcaagaagcagataaactgggctgcaaacagtttgttactcctgcagatgtggtttcaggcaatcctaaacttaatttagcttttgtagctaatttgtttaacacatacccgtgcctgcacaagccgaataataatgacatcgatatgaatttactggaaggagagagcaaggaagagagaacatttcggaactggatgaattccttgggagtcaacccatacattaatcatttgtacagtgaccttgcagatgctttagtgatctttcagctctatgagatgatccgagtgccagtcaactggagccatgtcaacaaacctccttatcctgcccttggagggaacatgaagaagattgaaaactgtaactatgcagtggaacttgggaagaacaaggccaaattctccttggttggcattgctgggcaggacctaaatgaagggaattcaacacttaccctggcattggtatggcagctgatgagaaggtacacattgaatgtgttatcggatcttggagagggtgaaaaagtaaatgatgaaattataattaaatgggtcaatcagactcttaaaagtgcaaacaaaaagacttctatttccagcttcaaggataaatctataagcacaagtttacctgtcctagatttaatagatgccattgcaccaaatgcagttcgtcaagaaatgatcaggagagaaaacttatctgatgaggacaagctgaacaatgctaaatacgccatttcagttgctcgaaagatcggtgcccggatatatgcattacctgatgacctcgtagaagtgaaaccaaagatggttatgacggtgtttgcatgcttaatgggaaaaggactgaacagaataaaataatcatttcatatgattttctgccacattaaacatattgtatgcctcaca

SEQ ID NO: 22667 - DNA, 635 bp, Homo sapiens
aataggcagaacacttcagtgtggaattgcttcttttctttggtcaaacactaactttggcagaggatagacacagcttaggaagactgaattttaagtcttctgaattgtttttctggacttccaaatctcaagtgataagaccagcagaagcagggaaggccagcgttggattgtgtaggttgcaaaatgcagtacctcagacttgcaactctgaaaagcactgtttgaaatctctgtaaagagtgaaaaacttcaagttttaaccaatgagtgttttagaggttaaagtttaaactctgacttggaagcacgctgggtaggactcctctgctcactcagactcaagttggatcatcagaatctctcttgtgttgctgtgaatgatttgcattgaaattcccagctagaactggaggaaagaggattacaaaccaggagatataaagacctgaagatagtcttttctgtccaaagatggaaaacagtactactaccatttctcgggaggagcttgaagaactacaagaggcatttaataaaatagatattgacaatagtgggtatgtcagtgactatgaacttcaagacctgtttaaggaagcaagccttcctctgcctggctacaaggtgcg

SEQ ID NO: 22668 - DNA, 2250 bp, Homo sapiens
ctttacatctttaaatggatgagatggctaccactcagatttccaaagatgagcttgatgaactcaaagaggcctttgcaaaagttgatcgttctacctcgccacgttaaattatagcttcagtataagatgagaaggcatagcatgctatttgatttatcctttatcatcatataacatgccttacaattgagcagctatggaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaagcttattgacttcagtaattcagtgaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcag

SEQ ID NO: 22669 - DNA, 3276 bp, Homo sapiens
aaagattccgaggtgcagaagttgtctgagtgcgttggtcggcggcagtcgggccagacccaggactctgcgactttacatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttacc

SEQ ID NO: 22670 - DNA, 3327 bp, Homo sapiens
gacttgctctctaaagttgcaattgtaagaagaatgttgggtttccagattgctcttctgggcgtgggagaaggttctgtctatcagtgctgcgagaaaggaaagaaacaagtttgctctcagcggatctttaaatggatgagatggctaccactcagatttccaaagatgagcttgatgaactcaaagaggcctttgcaaaagttgatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaagtaactggctgtgcagaatgtaatagaagcttttcttattcttttattcttaagatcagtatctttttacagtattctttctacatgatccttttttgtacatttaagaatattttgattatattaaacaagactgctgattttgctactttttttaaggggtcttcaagtaagtaaaacatacatcgtagctagaagaaaaatgtaccttaaatttgcatcttccctctcatacccaagctgtaaacaattgaaatattttgtcttaaatcacttggttcaatacatgcttatttgttttaaaacctgtatcatcaaactctctctctaaatttaaaatgctgttgaatatgatacttttgaggagagagtgtgctcagaacttagacgggatttggtaggccaagtatgctaagtgtacaatatattttttaattttacacctgaaacaaagaaatgtggtcactaaaaataaaagtatatatgtaggaattaatgtactcttgctttgtcaagctgtttgctatagtttccaaggtattatgttactctaactctgaaaagtgatgtaatctggtagcaatgtagtagttcaaataaaggcatttacataataattagtctgttcttcatgcttttgtctcttaggaagtatgccaatgtttgtcaggatttttttctttttgtttttctgatgtattctgtaaaatggtgtttgttaaatttgagttttgggagctgaattagaggtactgaattaaggacagtacaaatgaagtaaaaaggttttctccaatttaccaaaa

SEQ ID NO: 22671 - DNA, 2277 bp, Homo sapiens
agtcgggccagacccaggactctgcgactttacatctttaaatggatgagatggctaccactcagatttccaaagatgagcttgatgaactcaaagaggcctttgcaaaagttgatcgttctacctcgccacgttaaattatagcttcagtataagatgagaaggcatagcatgctatttgatttatcctttatcatcatataacatgccttacaattgagcagctatggaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaagcttattgacttcagtaattcagtgaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcag

SEQ ID NO: 22672 - DNA, 2858 bp, Homo sapiens
agattgctcttctgggcgtgggagaaggttctgtctatcagtgctgcgagaaaggaaagaaacaagtttgctctcagcggatctttaaatggatgagatggctaccactcagatttccaaagatgagcttgatgaactcaaagaggcctttgcaaaagttgtggagacggagtttcaccgtgttagccaggatggtctcgatctcctgacctcgtgatccgcccgtctcggcctcccaaagtgctgggattacagacgtgagccaccgcgcctggcctacacacatgtatttttaaaacgagagttgcagcaggggaaaaatgatggccaaactgctggaaattttgagtcagaaaaggactgataaacatttttgattgcctggtctcaccctctaaacttgtccagccttctgctgtacttgacctccatctttggaaatccactagtacagtgaattctaaagcagcaacctccagtctacccttagctggaactcattaaactgcctcttatatttgctgcagtgagctacctcaaaagatctcaacagcaacggattcatttgtgactatgaacttcatgagctcttcaaggaagctaatatgccattaccaggatataaagtgagagaaattattcagaaactcatgctggatggtgacaggaataaagatgggaaaataagttttgacgaatttgtttatatttttcaagaggtaaaaagtagtgatattgccaagaccttccgcaaagcaatcaacaggaaagaaggtatttgtgctctgggtggaacttcagagttgtccagcgaaggaacacagcattcttactcagaggaagaaaaatatgcttttgttaactggataaacaaagctttggaaaatgatcctgattgtagacatgttataccaatgaaccctaacaccgatgacctgttcaaagctgttggtgatggaattgtgctttgtaaaatgattaacctttcagttcctgataccattgatgaaagagcaatcaacaagaagaaacttacacccttcatcattcaggaaaacttgaacttggcactgaactctgcttctgccattgggtgtcatgttgtgaacattggtgcagaagatttgagggctgggaaacctcatctggttttgggactgctttggcagatcattaagatcggtttgttcgctgacattgaattaagcaggaatgaagccttggctgctttactccgagatggtgagactttggaggaacttatgaaattgtctccagaagagcttctgcttagatgggcaaactttcatttggaaaactcgggctggcaaaaaattaacaactttagtgctgacatcaaggattccaaagcctatttccatcttctcaatcaaatcgcaccaaaaggacaaaaggaaggtgaaccacggatagatattaacatgtcaggtttcaatgaaacagatgatttgaagagagctgagagtatgcttcaacaagcagataaattaggttgcagacagtttgttacccctgctgatgttgtcagtggaaaccccaaactcaacttagctttcgtggctaacctgtttaataaatacccagcactaactaagccagagaaccaggatattgactggactctattagaaggagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatcatgagagccctcaggggaaagggtttaagaaaaacaactcctctttcccatagtcagagttgaatttgtcaggcacgcctgaaatgtgctcatagccaaaacattttactctctcctcctagaatgctgcccttgacatttcccattgctgtatgttatttcttgctctgttatcttttgccctcttagaatgtccctctcttgggacttgcttagatgatgggatatgaatattattagacagtaattttgctttccatccagtatgctagttcttattcgagaactatggtcagagcgtatttggatatgagtatcctttgcttatctttgtagtactgaaaatttgccgaag

SEQ ID NO: 22673 - DNA, 916 bp, Homo sapiens
aaatcgcaccaaaaggacaaaaggaaggtgaaccacggatagatattaacatgtcaggtttcaatgagaaactcgtgaagaaagaaccttccgtaactggatgaactctcttggtgtcaatcctcacgtaaaccatctctatgctgacctgcaagatgccctggtaatcttacagttatatgaacgaattaaagttcctgttgactggagtaaggttaataaacctccatacccgaaactgggagccaacatgaaaaagctagaaaactgcaactatgctgttgaattagggaagcatcctgctaaattctccctggttggcattggagggcaagacctgaatgatgggaaccaaaccctgactttagctttagtctggcagctgatgagaagatataccctcaatgtcctggaagatcttggagatggtcagaaagccaatgacgacatcattgtgaactgggtgaacagaacgttgagtgaagctggaaaatcaacttccattcagagttttaaggacaagacgatcagctccagtttggcagttgtggatttaattgatgccatccagccaggctgtataaactatgaccttgtgaagagtggcaatctaacagaagatgacaagcacaataatgccaagtatgcagtgtcaatggctagaagaatcggagccagagtgtatgctctccctgaagaccttgtggaagtaaagcccaagatggtcatgactgtgtttgcatgtttgatgggcaggggaatgaagagagtgtaaaataaccaatctgaataaaacagccatgctcccaggtgcatgattcgcaggtcagctatttccaggtgaagtgcttatggcttaaggaactcttggccattcaaaggacttttcattttgattaacaggactagcttatca

SEQ ID NO: 22674 - DNA, 604 bp, Homo sapiens
atcttagtttccgcaccgcagttcctcggtgtccacttcaggcttccggactggaaggacagccgggaataaaacgtgccggcgaggctcaggagtcattggccacagagacccagcccgagtttcccatcgcactgagcactgagatcctgctggaagctctgccgcagcatgagctccgcagccgggttctgcgcctcacgccccgggctgctgttcctggggttgctgctcctgccacttgtggtcgccttcgccagcgctgaagctgaagaagatggggacctgcagtgcctgtgtgtgaagaccacctcccaggtccgtcccaggcacatcaccagcctggaggtgatcaaggccggaccccactgccccactgcccaactgatagccacgctgaagaatggaaggaaaatttgcttggacctgcaagccccgctgtacaagaaaataattaagaaacttttggagagttagctactagctgcctacgtgtgtgcatttgctatatagcatacttcttttttccagtttcaatctaactgtgaaagaacttctgatatttgtgttatccttatgattttaaataaacaaaataaatcaa

SEQ ID NO: 22675 - DNA, 522 bp, Homo sapiens
tcttagctcctgcaccacagttcctcgctgtccaccccaggcttccggactggaaggacagtgggacagtgacgggggataaaagaagcctggtgaggccaggagtcactgcctgcagaaccccagcccgactttccctgcgcactgggatcctgctggaacctcagctgcaacatgagctccgcagccaggtcccgcctcacccgcgccacccgccaggagatgctgttcttggcgttgctgctcctgccagttgtggtcgccttcgccagagctgaagctgaagaagatggggacctgcagtgcctgtgtgtgaagaccacctcccaggtccgtcccaggcacatcaccagcctggaggtgatcaaggccggaccccactgccccactgcccaactcatagccacgctgaagaatgggaggaaaatttgcttggatctgcaagccctgctgtacaagaaaatcattaaggaacatttggagagttagctactagctgcctaagtgtgcactttcaatcta

SEQ ID NO: 22676 - DNA, 2517 bp, Homo sapiens
agtggaggagctgctgctggtgctggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggcgtgagtcaccgcaccaggccatcttcaggtcattttaacaatacccctgagccacctgaagcttcctccctgtcctctcaccccaaacttcataaatcccctgtgacttaaaatggagctggactcatgggtccagcaagctcctcagctgtgtgttgaatggtcccatttctttggtccattcaacactcaggctcaggaagggtggtccacagggaaatataagtcaaataagccttatggccccaccctgaccgcttgagggccacggttagggttgagctctttgtatattatgccagggaatgcggtagctggacctgtgcacaaggccaggatcacatccctgaggccccgacatctcccctgtgtgctcacaagtctggctttgagacacaccactgcctttttttgctgactgctgcagccaacaaaaaggcattctctcccagtggacagacctcagaaaggacctattcataagtgcggggtagggcagagggactgaggaaagttctgcagacctgggaacagcaagaaaatgtgcagttgctgccctcccactctgtagacgcagggtcctgacgattcaaaagttaagtcttgagaccttgcaaaagggaaggatcccttcagagtttgcttggatggatttctctccagatattgccagcggaaagggagcaaacagaaatagtgatagtccacagttgtttggttccagagcagtggttctcaaacttcattgtgcatagcaagcttctggagtgccccgttaaattgcagttttctgggctccacctcccaagatgaattaagtgtgaagtaggactctggatgtgcgtttaaaacaggcgtagggtcacatcttgccccaaagttatgaggccaacttagagtagtggtgcttgcctgtaatccagctactcgagaggctgtggcagatcgcttgaagccaggagttcaagaccagcctgggcaatgtatcacgagtgtttcttaatgtttcagattatttactggcaagatgagcaggattaccatgaaagaaaagtccagatggactgaggaaatcctacactgattctccaaacttggcagctgactgcatggagggctcatgatgaagaaacctcttttgccatcctgaggattctctgattcatattcgcctagatgtgctggaaacagtactggaccaaggtgcaaacttgagtctagtgaggtactaatgggctgaagtttttctgagcgtcactttcctcatctgtataatgaggggttggccaaggaaacccataaggttatcttccagctgactttctaattggtgaaccctttggaaaaggggtgcagcttgcttctggtcttcatcctcaagtatgctgtgcttggacaggggccaaaactaattcctccactcaccatttgcccagcataactacaacagtacctggcacatcgtggatgcttattaaatatttattgcaggaatgagtaaatataactaactgatcataaggtaaaatagtcttcattggaacaaggctccagatagttgggcagggctgggagctgagactgctgcaatcctgccagctgagagaactctgacaaggcactgatctgggtggctttattaggatgtctgacagcttcagaggtggccacatttcttttcctttaaacatgtctaatttggccgggcgcagtggctcacgcctgtaatcccaacactttgggaagcctaggtgggtggatcactcgaggtcaggagttcgagatcagcctgaccaatatggtgaaaccccgctttactaaaaatacaagaaattagcagggtgtggtggcgggtgcctgtagtcccagctacttgggaggctgaggcaggagcatcgcctgaactcaggaggcggagattgcagtgagctgagatcacaccactgtactccagcatgggtgacagtgagactccatctc

SEQ ID NO: 22677 - DNA, 4195 bp, Homo sapiens
gtggcaggggaaccggaagtggaggagctgctgctggtgctggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattgggtttgttacctcgaggtgagaaacccaatcctttgaggcaaaagaacgccaaggtgaaccaactcctcaaggtttcgctgccgaagcttgccaacgtgcagctcctggataccgacgggggttttgtgcactcggacggtgccatctcctgccacgacatgtttgattttctgcatctgacaggagggggctatgcaaagatctgcaaacccctgcatgaactgatcatgcagttgttggaggaaacacctgaggagaaacaaaccaccattgcctgactggctcttatcagtgttaatagcatctcagcttcctcagatcagttctatcactggcactacagaatccttctctttcttaaggcactttgcattgtagaatgttcctggatgttcatatctagtgtttgaaggggaggagggatttaaactggtcctgtacatagaaggtttgtttgacagaggagaaaaattagccaaggaagattgttgtttaaattcatttgaaaccagaaggggactttttagttgtatgtgtaacacattcattgaattattatcactgttttcttgggacaacatcaagcctaaatactgaacaatatgaagattcttttcttggcctttctgtggattatgtcatatataataattatcagaatcattctacttggctttaaaacatgttttctccaatttttttaaggttcataatttagccttttgtttttatgttgcttagattcttatgtatactgaatattttattaacatgtagcatcaggttgaacatgcttgtcattgatatatggaagatgctatagttagaagtgaatttgttctgctttcttaatcttttccatgcttagcagtgaaaaacaggttttgccccagtagagggattctttggagggtattattttttatgctgctgaatatcatgtctataatagacccgtgcatgcagcctttcctccttattccccttcatgcccccctttccccttcattccccccgccaccccgtttttttttttttttttttttttttggttcttgttgacattacaagcttttaacacatttttgacctaggagccctgttgctggaagtatagtctccagccagttactctcatgatagtactgctataaaactcattcttgtgtggtgttctgtgctatagattctgtgtattgctgttcatattcggagttctggttttgtttttcccttaaaacctgttaacagttttttttgggggtggggggattcagaactcttgtttcccattccatagcacctgacattatttcaagttttataatatcttaaggtgtatattttattttttttattggcttagttgttttttgttttgttttgtttgagatggagtttcactgttgcccaggctggggtgcaatggtgtgatcttggctcactgcagcctccacctcccgagttcaaatgattctcctgcctcagcttcctgagtagctgggattacaggtgcatgccaccatgcccggctaatttttatatttttattagagacgggatttcgccatgttaaccaggctggtctcgaactcctgacctcaggtgatctgcccgccttggcctcccaaagtgctgggattacaggcatgagccaccgtgcctggccttattggcttagtttttaaattatcctccaaaaattttgggcctttttctgtggggaaacaagtgaagctgctcttcagcatagacactacctttatcccatcattttagtaaaaactaggtttgtttcacttctgaggtgtcttattaatgtacttcatctgagaatttgttgatcttaatgttcgagctatataagaactgccattaaaaaaaatgggataatagatgattttatcagtatacctgtggaatatgtacaaactggatctatagatattttgaactggaccaggtgggtattgaagtaacccatcaaaatatgctctgcagtgattccgcttaatgtttaaattcagtaacgtacttgaaaggcaaatttcagtgcttttgtatgttggaggagggcttactgatgcgtgctaagaccgatttctgattgagggatgaaccttgggctcatttttttcttgtgaagtctctttctagaaaattttttggttttgttctttttaaaaaatacatacttttttgaatgtatcatgtcttcattaacaacagaaaatccacatggtgtttactaaacttgtttacgacattaaaaatttcctttttatttttagtagcccaggttgagtttttcacaagagatttttttcttagctgaggtatagttgtatagcaagaagaattaagccagatttttgtgtgtggaaagacagttttctatccacgtctttttctgtttgtcagaaggtgggagtatggtccaaataaatccattaggttactcctgcagcatgcgcttttagcttctctcttgactgaggatcaaatatccctttgtgagctggccctcagctcctttgctcatgtgtacaaacctcagatgttactacattttatatctaccagagctattcaagcaatagtatttgaaccactagccttttaaataaaattctgccccattactgatgtgcagatattgagttcactttcattttttgccagatttctttgcactactttaggtaaaaatagttaatctatttttctttgacatcctagtttgcgtcagtgacagaacttactgcttagtctttgtactttttaaaaaatctataaatttaatgcactgtccaagtgaaatgtcctagttgtcattgtgattaaggggccaactttccaggcagctagcagagatactattctcttcctctcccagcaaatttgtattccttcgcccacgcattcctgctatactagatggcagccagtgatggaactataaagatgtctgtggtcatatgttgaatgtggcagcttgaagatgtactgccacgggtgatctagggcaggctgtcttccagtccatgtgttctcggtcgccgtagacagcgctctggctaccaccgtgaggctacttgaactgtcaggggcatctgcctaaaccagaatcttttgtcagaaaccttaacccaacaaaacaaatcttgagtagctcatgcccggctcttaggaattttgtctgtttaaaaaaaaaaaaaaaaaaaaagtccaacttactttattttatttttttaacctagtcactgtttacaattgtatgctaaagcctgaaatattgtctgtgctgtggtgtatgagcattgccaactttatatttattgcagtgaagaagaaactaaaaatatatggaaatgaggagcatgtccaagctcctaaatccgtgtgggtgcatgtgggagaagtgagttagggcctcttgaaaggaggctttttggagaggggtcccccaggtttcttggtgttcctgcttggggatcactgctgctagctgactggacctccccattggaagtttgtgattttgctttggcaaagtttcattgactagtagaactcattctgttttagtgtatatttcaatataaatgtaaacattttgctcaa

SEQ ID NO: 22678 - DNA, 1056 bp, Homo sapiens
tgctggtgctggggccggaggagggacgcgccggagcgggaccgacgggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattgattatttactggcaagatgagcaggattaccatgaaagaaaagtccagatggactgaggaaatcctacactgattctccaaacttggcagctgactgcatggagggctcatgatgaagaaacctcttttgccatcctgaggattctctgattcatattcgcctagatgtgctggaaacagtactggaccaaggtgcaaacttgagtctagtgaggtactaatgggctgaagtttttctgagcgtcactttcctcatctgtataatgaggggttggccaaggaaacccataaggttatcttccagctgactttctaattggtgaaccctttggaaaaggggtgcagcttgcttctggtcttcatcctcaagtatgctgtgcttggacaggggccaaaactaattcctccactcaccatttgcccagcataactacaacagtacctggcacatcgtggatgcttattaaatatttattgcaggaatgagtaaatataactaactgatcataaggtaaaa

SEQ ID NO: 22679 - DNA, 850 bp, Homo sapiens
gggaccgagcgagcgaccgacgcgccacccgccgacgcctcagccgcttggggcccgcacggaccctctacttcagtgtagaatgagccaaggagactcaaacccagcagctattccgcatgcagcagaagatattcaaggagatgaccgatggatgtctcagcacaacagatttgttttggactgtaaagacaaagagcctgatgtactgttcgtgggagactccatggtgcagttaatgcagcaatatgagatatggcgagagcttttttccccacttcatgcactgaattttggaattgggggagatacaacaagacatgttttgtggagactaaagaatggagaactggagaatattaagcctaaggtcattgttgtctgggtaggaacaaataaccacgaaaatacagcagaagaagtagcaggtgggatcgaggccattgtacaacttatcaacacaaggcagccacaggccaaaatcattgtattgggtaaagcagccgcctccaaatactctatctcagagatagtgagactagaacaagggtcggttaactggtcgatcgggacctatcctgatgacacaccagcaactaccaggccagcaatattacaattatttactggcaagatgagcaggattaccatgaaagaaaagtccagatggactgaggaaatcctacactgattctccaaacttggcagctgactgcatggagggctcatgatgaagaaacctcttttgccatcctgaggattctctgattcatattcgcctagatgtgctggaaacagtactggaccaaggtgcaaacttgagtctagtgaggtactaatgggctgaagt

SEQ ID NO: 22680 - DNA, 1076 bp, Homo sapiens
ggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggtgtgctagcgttgggacggtcctttgttgccgcgaggggtaggagtgggcgtggcggagccagctccgttcggaacactcccgggccgacccgactcgctcatcctgcaggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcagtg

SEQ ID NO: 22681 - DNA, 1098 bp, Homo sapiens
tcactctgtacagcaaatggtttcttcccatttgctagacagagggctagattttccccgcccactctcgactcttcaggtagttcgcccctccccgtgaccggtgggtggtttctccctcctccccgcctcgggagctggatggtctcgcctctccctccccccaccccgtgccgggtgcgcggcctgggagtcagcggcccgagcgggaagcgccgggcgagcccactgtgcggccgtcgtgggggaagcgaaggttcctgattccacctacctcctaagtgaaggcttccgtccctggagaggaggcggcgccctgtatcggccttcgtcctccgcgggagctgcggcgccaagatgagtggagaggagaacccagccagcaagcccacgccggtgcaggacgtacagggcgacgggcgctggatgtccctgcaccatcggttcgtggctgacagcaaagataaggaacccgaagtcgtcttcatcggggactccttggtccagctcatgcaccagtgcgagatctggcgcgagctcttctctcctctgcatgcacttaactttggcattggtggtgacggcacacagcatgtactgtggcggctggagaatggggagctggaacacatccggcccaagattgtggtggtctgggtgggcaccaacaaccacggacacacagcagagcaggtgactggtggcatcaaggccattgtgcaactggtgaatgagcgacagccccaggcccgggttgtggtgctgggcctgcttccgcgaggccaacatcccaacccacttcgggagaagaaccgacaggtgaacgagctggtacgggcggcactggctggccaccctcgggcccacttcctagatgccgaccctggctttgtgcactcagatggcaccatcagccatcatgacatgtatgattacctgcatctgagccgcctgggctacacacctgtttgccgggctctgcactccctgcttctgcgtctgctggcccaagaccagggccaaggtgctcccctgctggagcccgcaccctaagcatcctgctgccttcccacaacattaaactctccttcctcagtg

SEQ ID NO: 22682 - DNA, 1277 bp, Homo sapiens
actgcactccagcctgggcgacagagccacactctgtctcaaaaaaaaaaagcagacttaatagggtgaagaaaattaaaagatcctgaaaatgagggcctatgaagagggacaggaggtactctgaaacgtgtgatttggttctaaatcttaaaagacagaattggaataaaatatcattgtggctcctgagaggcatgctgccaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggct

SEQ ID NO: 22683 - DNA, 5614 bp, Homo sapiens
agggcgttggggcagctcctgtgacagacggagctggagcggcggggcggcggcggagtccggcggccgggagagcgagtgagcgagcggaggagcagcgacacgggagtctagggagcgagaaggagaaggaggggagcgctcgggcgcgagcgagagaaaccgcgagcgccgagcttggactcgagccccggaacggctgaggagcccgcccgctcccctcccctccccctccccgggcccgggcccagcgcgccatcctcccccctccttccctccctccctccttcctccctcccctctccctccccctcccccgccggtggatgggagtgaaggacggaagaggccctgcggaggcggcggtgcagcgctccggtggaatgaatcttacttgttgaatatcttctggttactagttggattcatttgtgaaagaatcattttcccctgtgtggaagacacttagtggcatatttaaattataagtccacggatcaaaaagctttttgatttcccaaaggagggacataccactatatcagataagcttgacattacagccaagatggtgctgtcccagagacaacgagatgaactaaatcgagctatagcagattatcttcgttcaaatggctatgaagaggcatattcagtttttaaaaaggaagctgaattagatgtgaatgaagaattagataaaaagtatgctggtcttttggaaaaaaaatggacatctgttattagattacaaaagaaggttatggaattagaatcaaagctaaatgaagcaaaagaagaatttacgtcaggtggacctcttggtcagaaacgagacccaaaagaatggattccccgtccgccagaaaaatatgcattgagtggtcacaggagtccagtcactcgagtcattttccatcctgtgttcagtgttatggtctctgcttcagaggatgctacaattaaggtgtgggattatgagactggagattttgaacgaactcttaaaggacatacagactctgtacaggacatttcattcgaccacagcggcaagcttctggcttcctgttctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgagactaaaaaaagtggtaaacctgggccattcttgctgtctggatccagagacaagactattaagatgtgggatgtcagtactggcatgtgccttatgaccctcgtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaaaagtggtggttattagggctttttctgaaatgtgtatctatgtaacatcacttaagtgtgcttaataaatcttctgtaaggattttagatgataaggctacaattcagaatcttctgaaccatctatgtaatgaatggggattatacattggaatttttgtcatgacacatttgccaaatcagtaggatatatttgttttggcagcctatcacgcagaggctagtggtatatttatgtaagaaaatgactgtaaatctcaagaaaaatctcagcagctaatagcaactcatttatttcattttggtcttaatgctttgtaaacaggtcaaaaaatactgtcatactctaagcttctattttccacactggacatacttctagttgtattctccatactattagactgtgtagtgatgtgacttccaagtagaatttaatctccccattgagtgtgtcatggtacaaatcactattcgtttttggtgttttttagggatgtgcaatgtgcattacataatgacagaaatactgagaaggttctgtgtgcccatttgaaaggagtgggaggaatacagcagtttgtttttcaacatgaatctgatattgatttaaactgtgtttcacttacaagttttaaaaaaatgacagggtttaatggagcgtgcataaaaatgtactgttttcaccttttgtttatatgtaaatgtttgtaagtatatgggcctatctgtaagtggataagtctgtatgtgtgtatcatacacatcaacctccatgtccttagtcctgggtttttgaaaaagtgctaaaacggacaagtagaataaatgttgctgtggaatgccatgctttagaacaaaccctttttgatcttaatgcttctgaaaactaggtctgactctggggatttttttccagccgaaggaaaatcacttccgttatgtccccctctaatttagccgctcgacattttacacaacccggatatgttgtatattttgacccaaagttacaggtaggtttaagagaatttttagccatgacttttggagcactattccattgtcagttattaataaagaattccattgcttagctaaccaacaggttttttttgtttccaagagagttatttgaaaagttaacagaacaatgagataacagtgacagtttaacaaagataaaattctgaactgcgttttattcatttgtgtactatgtgattttttaaatgtcccctttagtatttaatggaaaattggttcctgcaaaagacaaagggtgagagttagcgtcctgtagatacacacagagactaggccgtatattaactagaagcagctttatgtctagcttgtgtctttttgtttgtttgcttgtttgtttttagattcctgagagatgtctctggaagggaaagttttgagaactaatggctatttttgaggacaaaaattacatcttaagctaattccttaaatacatacagtaggtgaattttcaggacaatattgcctcacaaccctgcttacattgaaaagtctttttcccttagctcttctgactggatttttctacaaaaactatggaaaatatctttgttcttgtttgctgctattttctgtcctattttgagaaatataaatacatagaaatggtgcatcttaacatttgtttgtacatgtataaatgtcttgtattttaattcatttttagcatgaattgtttaagggtaagccacaacatctagaaatcactcatagatattgaacaataaaggagaatggtaccgatgcaggaggaagcaagcgtgtcttcccctgcagcacacagcgacttgcgttgacaaaggaggaggaaacgattactctgtaaacaaagttatccttacttgggagattgccacagcctgctgctgagttgagttaccagacatcctccatgtgagaagcagcgaacattgaatctcagggatggcccacaactgggtccacatgtaatgagccctgtttaataacgaaggggtgggggagagcagtccgtctacaacctggaatcagatttgcaaaatttcctgcactgctgtctgacactgtcctgttgatgccctttctgactgtgttctctgttttctctgtctgctgtctaaccctgtgccttgcctgggataaggacaatgatgaggttactggtttggattgtaagtagaggacttttattaattggtttagaggttcactgctgctttgtcactttctcaatcaaattggccacttaagaaataaagagctggtagaattgcatcctcagatgattattgactgtgtgtgtgtgtgaaaacagacattccagtgccacccaaatatatatctgtaacgtgcccaagaaatcctagctgcgctcttgagagtgcatgccatggagactggtttagacaccgcgtggagcctagttgcctgttgtcacggcatcttgcactttaggagactaagaccgtcctggttcgtctgtgtgtggtgtgaccaatggtgtgcccagagcactactctcaaaatcactagtgttagcaagtcgtcccgggctggggagcgttcgccgtagtctttggaagctttggctttagatttaccaagccccgcctccccgctgccagtgccctgctctcccgttcgcctctttctgtttctgtgtgaactttcccggtaatatcactcgttaaataggttttctttaaacttaattaaagaaaaactatttaaaggtaaaggatattttgttgacatcggtggctcgatcatccttaagcaactgaagttaaaattgttgaaggaaaaggcacttaaattggttactttcatgtccagctgtatataagtccagtgtgttcatctagatgacgcaaagaatctcctggtagagaagcgacatgtaaaaaactggtggaaaaaggttttggattttttttccagtggggtggggggagggcaagctggatttacaggtcacggctggactgaatgggcctttttatcttcccactgtatcatggaagtagctgcttgcttgtactgtccatccttcaggcatccctaaagctcactctgaagatgttagagacaaacacaaactcttcgagttaaagttgatcctgacactgacatgaaggcaagccttgatttcgtatgaacgttgctgaagtggtaattgaggaaaacagttccccagattgttaagagttcactgaagatattgacacaattttaaaaaatcagtaaaggaatgtatataatattgctctcgtgttttacagtaagatttgttgctctcagactgtgtaaaacaaaatttattcatgttttctgcatattaaaaaatcttattgtaccaactggtaaactattaaatgcctataaaacta

SEQ ID NO: 22684 - DNA, 1021 bp, Homo sapiens
tctgcagatatgaccattaaactatgggattttcagggctttgaatgcatcagaaccatgcacggccatgaccacaatgtttcttcagtagccatcatgcccaatggagatcatatagtgtctgcctcaagggataaaactataaaaatgtgggaagtgcaaactggctactgtgtgaagacattcacaggacacagagaatgggtacgtatggtacggccaaatcaagatggcactctgatagccagctgttccaatgaccagactgtgcgtgtatgggtcgtagcaacaaaggaatgcaaggctgagctccgagagcatgagcatgtggtagaatgcatttcctgggctccagaaagctcatattcctccatctctgaagcaacaggatctgaggtgggtcatgataactgggtacgtggagttctgttccattctggggggaagtttattttgagttgtgctgatgacaagaccctacgcgtatgggattacaagaacaagcgatgcatgaagaccctcaatgcgcatgaacactttgttacctccttggatttccacaagacggcaccctatgtcgtcactggcagcgtagatcaaacagtaaaagtgtgggagtgccgttgattgtgtctccttcggcccctcctccctcttttcctctggatgcactctgatgataccatggttaccccattgagctctgtttaaataaatattgtcctttcatgtaaattattctggatgtagattgagcttattaaatgttacacacaaagtattcatgcatggtgaatccaaattgtatactgtaaatttacatacgttgtctagaagtaccatagggtttaaaaacctgggctggcattggtcacaccaggcctaagaaggcagaagttgaatcaattgaactagggcactaaactgaatagttgacagtgtcattttatgttggattattaattcctgtttttctttctgctatctgttggtgcctgacttgatggcctcatttggggaa

SEQ ID NO: 22685 - DNA, 1539 bp, Homo sapiens
cctcctgtgcactcattacctgcttcctgagctccccgagaagtcatccaggacctccccgagaagccgtccaggaaacatgctctcaggggacccccatctgcctcagcctctttgtcactgcctggaccattgtccctgctgtttctcaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaacca

SEQ ID NO: 22686 - DNA, 4491 bp, Homo sapiens
ggcacatgctcgctgtctgtgtcttgtcatctcgtcttttgtcttggatcttaccttgtctttgtccctgaatctccttgttcctctcatctctcccggtgtttacatctgtctttttccctgagcctcgctccctccatccattcctccgccctctcattttttttcccgactccctcctgcctcctccctttctcctttgattttcctggtccctcatctctcctccctcctctttctcactctcatgctccctttttcgctctcttgagtacatgcacttgctttctctctcttgcttttcctctttctcaccttagctcctggcctcgggcgctgtctacaccccaccccatccctcgctctttgagaagcctctgtgcagtgcccaggtcctggcggcccagcttggaagttcctgtggtaccccttgagaggccctagggccacagcatttcctcccaggggtgacttggtagtgatacgctctgtttcttcacttctgcaattgccagacagcatagaggctgaggctggggccaggacccagacagagacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctggccaacattgtaaaaccccatctctactaaaacatacaaaaattagccgggcatggtggcacacgcctgtagtcccagctactcaggaggctgaggcaggagaatcgcttgaacctgggaggcagaggttgcagtgaacctagattgcaccattgcactctagcctggcaacagagcgagattccatctcaaaaaaaaaaaaaaaaaaaaaaaaaaagctttgggcaactactctcaagtgatagaggtagactgggttaggaaaggacactgccctcactgtatggcactaccttggggcagacttttgagctaagatgttgccatcctctctccaccctccggcacaaggtctttgtgacctttctcaggggaaggggcttgatggaaccttctctgactcatctggcaacctgtccctaatggtgaccaaagaagataaaacatgaacagaccaaaagctaggacaagagcttgcttcccaagacagacgtgtctgtctgcaaaggccttgcctctagtccagtcagctctgggggagtgggaaggagatgcccacctcctctttctgtctcaacaatagtccctaattaagtaccttctgtggggcagccacccactgagggtgggcaaaggccccttgaaagcaaaattggggctgggctcagtggctcatgcctataatcccagcactttgggaggccaaggcaggcagatcacctgaggtccggagttcgagaccagcctggccaacgtggtgaaacgccatctccactaagaatacaaaaatatggctcatgcctgtaatcccagtactttgggaggctgaggtgggccgatcatttgaagttaggagtttgagaccagcctgaccaatatggtaaaaccccgtctctactaaaaatacaaaaaaattagcctggcgtggtggcgcatgcctgtagtcccataggctgtagctactgggaggaggcggagcttgcagtgagccgagatcacgccactgctctccagcctgggcgacagagtgagactctgtgtcaaaaacaaacaaacaaacaaaaaaggcaaaattggagctgtccaggccaggacaccccgatgtccaggggcttccatacgaacaggcacatgggctgggaagtacatgaggcccctgggtagaagggtctgtcagttctctcctcccttgccctctgggagggtcctcctaacatagcttccaggaggtgggaggagcagttactgtcagcaggtgtcagccaggtgtcagcttctcctggggatctctagatgtctgcttgtgatttttggcaagtatatgcaaatgagcctcctctcctgccctgagacaagtatctgcagtgtgaacctggcagcctcagacccaaggggctcagaggaaacttctctggtttctagagctctgtgctccttcagagaagtcttccttccttccagtcagtgtccctgtgaagctgggatactcatttcctgtgtaccgggcaaacaccggattgctgattttgagaaatgcctctcgatggacctgtaacctgctggagtctgggatggtagctgtgggctggacttggctgatgggatgacccggtggctagtgcagcatcacacaagcctggttcaagtcttggctgtgtcatttcctgctgagggaccaggcactgaatttcctacctcttagggtcattacctatgaggttaaagctacctcatgggattgttatacgccactaatgttgaggcagacacctcttggcagggtgactgctcatcttagaccctccccttttctgcgaatttgggccccttgatcctctgatgggagctgaaaggatgagaggtgggcatctagatttagggaggctgttcaggctttgcaggtcccttacctgaacacatagaaaccctggagctgtgactgtgtccatgtgtgtgtgtttgtctgtgtgtgttgcgggggatgggcacctgcatgaatgtggtagagaaaatggctctgctcagagggaagatacgcatagcaaggcagggaccagaggaatcacaggcgcctggagagcagccgggcaccgcctccagggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaattaa

SEQ ID NO: 22687 - DNA, 4191 bp, Homo sapiens
gctgctgctcattggagggtagagcagagtgagtcacacacctgtgcctgggcccgtcctctgcctcctgtgcactcattacctgcttcctgagctccccgagaagtcatccaggacctccccgagaagccgtccaggaaacatgctctcaggggacccccatctgcctcagcctctttgtcactgcctggaccattgtccctgctgtttctcagacagcatagaggctgaggctggggccaggacccagacagagacacacggtcactgcagctgaagccgctgcccctgctacaggcaccaccaggaccagctgatcattccagcccacagcaatggagccacatgactcctcccacatggactctgagttccgatacactctcttcccgattgtttacagcatcatctttgtgctcggggtcattgctaatggctacgtgctgtgggtctttgcccgcctgtacccttgcaagaaattcaatgagataaagatcttcatggtgaacctcaccatggcggacatgctcttcttgatcaccctgccactttggattgtctactaccaaaaccagggcaactggatactccccaaattcctgtgcaacgtggctggctgccttttcttcatcaacacctactgctctgtggccttcctgggcgtcatcacttataaccgcttccaggcagtaactcggcccatcaagactgctcaggccaacacccgcaagcgtggcatctctttgtccttggtcatctgggtggccattgtgggagctgcatcctacttcctcatcctggactccaccaacacagtgcccgacagtgctggctcaggcaacgtcactcgctgctttgagcattacgagaagggcagcgtgccagtcctcatcatccacatcttcatcgtgttcagcttcttcctggtcttcctcatcatcctcttctgcaacctggtcatcatccgtaccttgctcatgcagccggtgcagcagcagcgcaacgctgaagtcaagcgccgggcgctgtggatggtgtgcacggtcttggcggtgttcatcatctgcttcgtgccccaccacgtggtgcagctgccctggacccttgctgagctgggcttccaggacagcaaattccaccaggccattaatgatgcacatcaggtcaccctctgcctccttagcaccaactgtgtcttagaccctgttatctactgtttcctcaccaagaagttccgcaagcacctcaccgaaaagttctacagcatgcgcagtagccggaaatgctcccgggccaccacggatacggtcactgaagtggttgtgccattcaaccagatccctggcaattccctcaaaaattagtccctgcttccaggcctgaagtcttctcctccatgaacatcatggactgagctgggggaagaagggatatctactgtggtctgggcaccacctctgtgggcactggtgggccattagatttggaggctacctcacctgggcagggatgatggcagagccaggctgttggaaaatccagaactcaaatgagccccttcatccgcctgtgggcgcatactacagtaactgtgactgatgactttatcctgagtcccttaatcttatggggccggaaggaatgtcagggccaggtgcagaccttgggggaagactttaaaccacctagttctccccgatggggcatcggtctaaagctttgggggagtgggcgcagtggctcacacctgtaatcccagcactttgggaggccgaggtgggcagatcatgggtcaagagatcgagaccatcctggccaacattgtaaaaccccatctctactaaaacatacaaaaattagccgggcatggtggcacacgcctgtagtcccagctactcaggaggctgaggcaggagaatcgcttgaacctgggaggcagaggttgcagtgaacctagattgcaccattgcactctagcctggcaacagagcgagattccatctcaaaaaaaaaaaaaaaaaaaaaaaaaaagctttgggcaactactctcaagtgatagaggtagactgggttaggaaaggacactgccctcactgtatggcactaccttggggcagacttttgagctaagatgttgccatcctctctccaccctccggcacaaggtctttgtgacctttctcaggggaaggggcttgatggaaccttctctgactcatctggcaacctgtccctaatggtgaccaaagaagataaaacatgaacagaccaaaagctaggacaagagcttgcttcccaagacagacgtgtctgtctgcaaaggccttgcctctagtccagtcagctctgggggagtgggaaggagatgcccacctcctctttctgtctcaacaatagtccctaattaagtaccttctgtggggcagccacccactgagggtgggcaaaggccccttgaaagcaaaattggggctgggctcagtggctcatgcctataatcccagcactttgggaggccaaggcaggcagatcacctgaggtccggagttcgagaccagcctggccaacgtggtgaaacgccatctccactaagaatacaaaaatatggctcatgcctgtaatcccagtactttgggaggctgaggtgggccgatcatttgaagttaggagtttgagaccagcctgaccaatatggtaaaaccccgtctctactaaaaatacaaaaaaattagcctggcgtggtggcgcatgcctgtagtcccataggctgtagctactgggaggaggcggagcttgcagtgagccgagatcacgccactgctctccagcctgggcgacagagtgagactctgtgtcaaaaacaaacaaacaaacaaaaaaggcaaaattggagctgtccaggccaggacaccccgatgtccaggggcttccatacgaacaggcacatgggctgggaagtacatgaggcccctgggtagaagggtctgtcagttctctcctcccttgccctctgggagggtcctcctaacatagcttccaggaggtgggaggagcagttactgtcagcaggtgtcagccaggtgtcagcttctcctggggatctctagatgtctgcttgtgatttttggcaagtatatgcaaatgagcctcctctcctgccctgagacaagtatctgcagtgtgaacctggcagcctcagacccaaggggctcagaggaaacttctctggtttctagagctctgtgctccttcagagaagtcttccttccttccagtcagtgtccctgtgaagctgggatactcatttcctgtgtaccgggcaaacaccggattgctgattttgagaaatgcctctcgatggacctgtaacctgctggagtctgggatggtagctgtgggctggacttggctgatgggatgacccggtggctagtgcagcatcacacaagcctggttcaagtcttggctgtgtcatttcctgctgagggaccaggcactgaatttcctacctcttagggtcattacctatgaggttaaagctacctcatgggattgttatacgccactaatgttgaggcagacacctcttggcagggtgactgctcatcttagaccctccccttttctgcgaatttgggccccttgatcctctgatgggagctgaaaggatgagaggtgggcatctagatttagggaggctgttcaggctttgcaggtcccttacctgaacacatagaaaccctggagctgtgactgtgtccatgtgtgtgtgtttgtctgtgtgtgttgcgggggatgggcacctgcatgaatgtggtagagaaaatggctctgctcagagggaagatacgcatagcaaggcagggaccagaggaatcacaggcgcctggagagcagccgggcaccgcctccagggacctgccggcttccctcagtcctccaggggcccagcactcttcctttaggccctgtgagcgtcccttgtcaggatacattctctcattttgctgaagctgatttgattgggtgtctgtttctcgcagccaaaagagctctgaatgaggaaagtgcttctgtgctaactccccgcgtctcctgaatttcagtcattcatgtacccgcctcgaaatttttgcaatatctgtgtaccaactgtccatttacttaataaagaagttttctttaaattaa

SEQ ID NO: 22688 - DNA, 1875 bp, Homo sapiens
acttctgccttgttatcagaggagcgaggatgtggcctgtgtgccgcctaatcatgcctagaactgtctgcacctgctgatcttttgcttctgcgaactggctgcacctgctgttctcctgctcataccctagcccgtgcttaccctaattccctgttctcctgcctcaccaccagaggcccgggttgtctgcacagtctcattttccacgttattcctgtaatgaacccgtcctcccacccccaccagcagttacagggctgggtgcggagaccaactctggccagacacagaggagcagcaagaacccggggcaacggtcctaaaccgaatcctcccgcttcggcgtcccaggagcccgcccctcgcccgccgcctcccctgcgtccccgccccgcgcagccgccgcgctcctgcgctccgaggtccgaggttcccgagatgaaggtctggctgctgcttggtcttctgctggtgcacgaagcgctggaggatgttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctatgtggcggttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggatgaaaggcctgtgacgatccaagacacttggaggttgatccacagaggactgggacacaccacgagaatctcccagagtgtcattacagtggaagactttgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgt

SEQ ID NO: 22689 - DNA, 1495 bp, Homo sapiens
cctgcgtccccgccccgcgcagccgccgcgctcctgcgctccgaggtccgaggttcccgagatgaaggtctggctgctgcttggtcttctgctggtgcacgaagcgctggaggatgttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctatgtggcggttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggatgaaaggcctgtgacgatccaagacacttggaggttgatccacagaggactgggacacaccacgagaatctcccagagtgtcattacagtggaagactttgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgt

SEQ ID NO: 22690 - DNA, 1905 bp, Homo sapiens
acttctgccttgttatcagaggagcgaggatgtggcctgtgtgccgcctaatcatgcctagaactgtctgcacctgctgatcttttgcttctgcgaactggctgcacctgctgttctcctgctcataccctagcccgtgcttaccctaattccctgttctcctgcctcaccaccagaggcccgggttgtctgcacagtctcattttccacgttattcctgtaatgaacccgtcctcccacccccaccagcagttacagggctgggtgcggagaccaactctggccagacacagaggagcagcaagaacccggggcaacggtcctgtgaaaaccgaatcctcccgcttcggcgtcccaggagcccgcccctcgcccgccgcctcccctgcgtccccgccccgcgcagccgccgcgctcctgcgctccgaggtccgaggttcccgagatgaaggtctggctgctgcttggtcttctgctggtgcacgaagcgctggaggatgttactggccaacaccttcccaagaacaagcgtccaaaagaaccaggagagaatagaatcaaacctaccaacaagaaggtgaagcccaaaattcctaaaatgaaggacagggactcagccaattcagcaccaaagacgcagtctatcatgatgcaagtgctggataaaggtcgcttccagaaacccgccgctaccctgagtctgctggcggggcaaactgtagagcttcgatgtaaagggagtagaattgggtggagctaccctgcgtatctggacacctttaaggattctcgcctcagcgtcaagcagaatgagcgctacggccagttgactctggtcaactccacctcggcagacacaggtgaattcagctgctgggtgcagctctgcagcggctacatctgcaggaaggacgaggccaaaacgggctccacctacatcttttttacagagaaaggagaactctttgtaccttctcccagctacttcgatgttgtctacttgaacccggacagacaggctgtggttccttgtcgggtgaccgtgctgtcggccaaagtcacgctccacagggaattcccagccaaggagatcccagccaatggaacggacattgtttatgacatgaagcggggctttgtgtatctgcaacctcattccgagcaccagggtgtggtttactgcagggcggaggccgggggcagatctcagatctccgtcaagtaccagctgctctatgtggcggttcccagtggccctccctcaacaaccatcttggcttcttcaaacaaagtgaaaagtggggacgacatcagtgtgctctgcactgtcctgggggagcccgatgtggaggtggagttcacctggatcttcccagggcagaaggatgaaaggcctgtgacgatccaagacacttggaggttgatccacagaggactgggacacaccacgagaatctcccagagtgtcattacagtggaagactttgagacgattgatgcaggatattacatttgcactgctcagaatcttcaaggacagaccacagtagctaccactgttgagttttcctgacttggaaaaggaaatgtaatgaacttatggaaagcccatttgtgtacacagtcagctttggggttccttttattagtgctttgccagaggctgatgtcaagcaccacaccccaaccccagcgtctcgtgagtccgacccagacatccaaactaaaaggaagtcatccagtctattcacagaagtgttaacttttctaacagaaagcatgattttgattgcttacctacatacgtgttcctagtttttatacatgtgtaaacaattttatataatcaatcatttctattaaatgagcacgtttttgtaaaaaataaaaagtgggataagtgtt

SEQ ID NO: 22691 - DNA, 4183 bp, Homo sapiens
atgtaacaggtcatgtggcagcctcctagggacacgcgtggggtctggagcgggacacgcgtgtgcagccgggccttacgtgtggctcaaggggcggtgggcgagagagacgtggacacaagtggggtggggcacgtgagggtctggggaatagaaccaggggttccatgcgccctcctccttgtctggggcgggtcttaggttggcgggagagcccagcggggacctagcgacaaggggggctggcagcctccggggctctgggccctgggagagggcggggggtgggggggattagcgttgcctgagcggcgcgtagggggtagggggagggactgagaggcgggcgggcctggagcaaacgggagccgcgctgccttcacagctcagctgggcccagcctctcctctgtctctcctcggtctcagctctgggcgagcagcggcctgtctgaagagcatgcagcccccttactccccgcctggcctcgccatccctgcccccccagcctgacccccggccccagcatggcccagggtgccatgcgcttctgctcggaaggcgactgtgccatctccccaccacgatgcccacgccgctggctccccgaaggcccggtgccccagagccccccagccagcatgtatggcagcacaggctccttgctacggcgagtggcaggtccaggtcctcgaggccgggaactgggacgtgtgacagcaccctgtacacctctgcgtggccccccctcaccccgtgttgctccctcaccctgggcaccctcttcacccactgggcagcccccacccggggcccagagctctgtggtcatcttccgctttgtggagaaggccagtgtgaggccactgaatgggctacctgctccagggggcttgagtcggagctgggatctgggtggggtttctcctcccaggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttgcccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagagcggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggccataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgc

SEQ ID NO: 22692 - DNA, 3859 bp, Homo sapiens
cgcaaggcagcgagaagggagaagctagcagcggggagagacaagaaaggggtcaagttagctcagctgggcccagcctctcctctgtctctcctcggtctcagctctgggcgagcagcggcctgtctgaagagcatgcagcccccttactccccgcctggcctcgccatccctgcccccccagcctgacccccggccccagcatggcccagggtgccatgcgcttctgctcggaaggcgactgtgccatctccccaccacgatgcccacgccgctggctccccgaaggcccggtgccccagagccccccagccagcatgtatggcagcacaggctccttgctacggcgagtggcaggtccaggtcctcgaggccgggaactgggacgtgtgacagcaccctgtacacctctgcgtggccccccctcaccccgtgttgctccctcaccctgggcaccctcttcacccactgggcagcccccacccggggcccagagctctgtggtcatcttccgctttgtggagaaggccagtgtgaggccactgaatgggctacctgctccagggggcttgagtcggagctgggatctgggtggggtttctcctcccaggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttgcccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagagcggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggccataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgc

SEQ ID NO: 22693 - DNA, 3365 bp, Homo sapiens
caaatctggcgctgtccccttcagcaccacgcggagtccgcgccgcccctccccgcgctcagctgggcccagcctctcctctgtctctcctcggtctcagctctgggcgagcagcggcccaccccagcccttgggcctggctccaaccggaagttacggctggaagcatccacatcagacccactccccgccagaggaggctcggccctacctggcagccggaaccttgtacatgggccgccagccccaccccaggttggagcagatggcctttactcctctctccccaatgggctggggggcccccctgagcgcctggccacactcttcggaggacctgctgacactggattcctgaaccagggggatacctggtcctccccccgggaagtctcctctcatgcccagagaatcgctagagccaaatgggaattcttctatggctccttggacccccccagctcaggtgctaagcccccagagcaggcccccccatctccacctggggtgggctcaaggcagggctctggggtggctgtggggcgagcagccaagtactccgagacagacctggacacggtgcccctgaggtgctaccgcgagactgacatcgatgaggtgctggctgagcgggaggaggccgactcggccatcgaaagtcagcccagctctgagggcccaccaggcactgcctacccacctgccccacggcccggcccactccctggccctcatcccagcctcggcagtggcaatgaggatgaggacgacgatgaggcaggtggggaagaagatgtggacgacgaggtgtttgaggcctctgaaggggcccggccagggagccggatgcctctcaagtcacctgtgccctttctacctgggacgagcccctcggctgatgggcctgactctttcagttgtgtgttcgaagccatcctggagtcacaccgggccaaaggcacctcctataccagcctcgcctcgctggaggccttggcctcacctggcccaacccagagccccttcttcacctttgagctgcctccccaaccccctgcaccccggcccgacccaccagctcccgccccacttgcccctcttgaaccggattctggtaccagctctgctgctgatggtccttggacacagagaggggaggaggaggaggcagaggccagagccaagctggccccagggagggagccccctagtccctgccactcagaggacagccttgggctgggggcagcaccccttggcagcgaaccacccctgagccagctggtgtccgactcagactcagagctggacagcacagagcggctggccctgggaagcacagacaccttgtccaatgggcagaaagcggacctggaggctgcgcagcgcctggccaagaggctgtaccgactagatggcttcaggaaggccgatgtggcccggcacctgggcaagaacaatgacttcagcaaactggtggctggggagtacctcaagttctttgtcttcacgggcatgactctggaccaagctctcagggtgtttctgaaggagctggccttaatgggtgagacccaggaacgagagcgcgtgctggcccacttctcccagcgatacttccagtgcaatcctgaagccctgtcctcagaggacggcgcccacacgctgacctgtgcgctcatgctgctcaacacggatctccacggccataacatcgggaagcgcatgacctgcggggacttcatcgggaacctggagggcctcaatgatggcggcgacttccctagggagctgctcaaggccttgtacagctccatcaagaatgagaagctgcagtgggccatagacgaggaggagctgagacgctctctgtctgagttggccgaccccaaccccaaggtcatcaagcggatcagcgggggcagtggcagtggctccagccctttcctggacctgactcccgagcctggggctgccgtctacaagcacggggccctggtgcgaaaggtgcacgcagaccctgactgcaggaagacacctcggggcaagcggggctggaagagcttccacgggatcctcaagggcatgatcctctacctgcagaaggaggagtacaagcctgggaaggccctttcagagacggagctcaagaatgccatcagcatccaccatgccctggccactcgtgccagtgactacagcaagaggccccacgtcttctacctgcgcacagctgactggcgggtcttcctcttccaggccccgagcctggagcagatgcagtcctggatcactcgcatcaatgtagtagccgctatgttctctgcgccccccttcccagctgctgttagctcccaaaagaagttcagccgccctctcctgcccagcgctgccacccgcctctcccaggaggagcaggtgcggacccacgaggccaagctgaaggccatggcaagtgagctgcgggagcaccgggccgcccagctgggcaagaagggccggggcaaggaggctgaagagcagcggcagaaggaggcctacctggagtttgagaaatcccgctacagcacctatgcagcgctgcttcgggtcaagctgaaggcaggcagtgaggagctggatgcagtggaggcagcactggcccaggccgggagcacagaggatggactccctccttctcactccagtccctccctgcagcccaaaccctccagccagccccgggctcagcgtcacagctcagagcctcggccaggggcaggcagtgggcggcggaagccctgagatgaggtttagggtggggagtgcctgctgggcacctgaaggatgacatggccctgcctgagcccgggccggcctcgggccacccacgagggcctcccggcctagggcccgaccgcgccggacgcggtgtccggggcagggcagggctggggcctgggcctcaggagcctaggctaggggcacctccgagagcccctttttgtgataatgttttgcactttttcgtacagggtgggcgggggcgggaggggctagcgcccctgaacttttgatgctttttttttgtgtgggagaggcctgatgccgtttctgctttctgctgagaccacccccaccctgacaccatcagtccccctctgtcctggggcctggcttggacagagaccaggatttggggctgagctggtttcccctccttcctccccaagggcttactctttctcttgctggaggtggaggaagggcgtccatgccaaggccccatacctgggccgggggcagcacggcctggctttcccccgcttcagtgggccttgccctttgtacagcctccacccccattaaaactgctctggacttgc

SEQ ID NO: 22694 - DNA, 6665 bp, Homo sapiens
aggctcggcagtcactgaacttgggagctgaagaatactggacggggcttcggagaggaaggatggtccaggcgcaccccaggggttgcgatgggctcttcttggtgtctgtatggttgctgcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacag

SEQ ID NO: 22695 - DNA, 11689 bp, Homo sapiens
aacaaagagcacgcggcgctggccgccggcactcgcgccctgaggctgcggccccggagcgcccggcggcggtttcggcgcgcggccgggctggcgatggaagatggaaggaaggagcgcagcggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatcatt

SEQ ID NO: 22696 - DNA, 6136 bp, Homo sapiens
ggtgcttcttaagctaacgcggatcacggcgctcaggagctgctcaggcacaaccccgcagagttcctccagcgtgagagccttggaacggttggaaagtgcctttttatttctctaaaccccttccttagttgaccttcgaaaatgattggcgtgaatagtgtccagagtgccagcaaggtacgggtgaggacctcaggttccgtgaaatactcccgggaggattctatccggcggcagtctcacaggtcaaagtccatgaaaatttccaactcctcagagttttctgctaaggagaacaaggctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaagcatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtcc

SEQ ID NO: 22697 - DNA, 11693 bp, Homo sapiens
aacaaagagcacgcggcgctggccgccggcactcgcgccctgaggctgcggccccggagcgcccggcggcggtttcggcgcgcggccgggctggcgatggaagatggaaggaaggagcgcagcggcagagacatttgtttgggtgaacaatgcatctgcacattcccagagtgttgccaaggccaaatatgaatttttatttggcagatctgaagggaaagctccagatactagtgatcatggaggaagcactttactcccaccaaatgtcacaaatgaatttccagaatatgggaccatggaggaaggtggagaaggcctaagggcttctctggaatttgatggtgaggctctgccatgccacccacaagagcagcagggtgtccagcctcttactggctgccactctgggctcgacagtgttacagaaggaccaaaagatgtcagagaggccccctctcaaagtcatctcaaggaacaaagtttacagcccattgactctttgatttcagctctgaaagccacagaagccagaatcatttccggaacattacaggctacaaaggtactggaccaagatgctgtttctagtttttcagttcagcaggtggaaaaagagctggacactgccagtcgtaaaacacagagagtcaacaaaacgctccctgctggccaaaaaaatttaccagaaatacctctttcagctgaagtaacaacggaggaaagtttttatttgagcatccagaaagatctcaccgcgctgttaactggagacactcaggcagagatttcccagataatgaataatgggaggaaaggggctgtctgtgtgcaggagccatcttgtcctttggcctccctcgggagctcagcagtgacctgccactctgcaggcagtgttggtttcttgaaagagcagaggtctgctcttgggagagagcacccagggggatgtgatcgaagcagctccatgggacgcccaggccgggtcaaacatgtggaatttcaaggagtggaaatactgtggacaggaggagacaagagagagacccagcatcctatagattttgagacatcactgcaaagaacagcctctcctgacagcaaagagtcttccaaagtgccacgccatctcatctcatcagctggtttgtgtaattcaagtagtttaactgagaatgtttgggatgaatcctggaaagctccttcagagaggcctggcactagctcggggacattttcccctgtgcgtcttgatgagagtggagaggatgaagtcttcctacaggaaaacaaacagcatcttgagaagacacctaaaccagagagagacagggaaaggatcagcgaacaagaggagcacgttaagggggaagatgaagacatccttgggcctggatatacggaggactccaccgacgtgtacagctcccagtttgaaaccattttggacaacacttctttatactacagtgcagagtccctggagacattatactcagagcctgatagctattttagctttgaaatgcccctcactccaatgatacaacagcgcattaaagaaggtggtcagttcttggagaggacatcagggggaggacatcaggatatcctgagtgtgtctgcagatggtggcatcgtgatgggctattctagtggcgtcaccaatgggctgaatgatgccagcgactccatctacacgaaaggcaccccggagattgctttctggggaagcaatgctggggtgaaaacaacacggctagaagctcattctgaaatggggagcactgaaattttggaaaaggagaccccagaaaatctcagtaatggtaccagcagcaatgtggaagcagccaaaaggttggccaaacgcctttatcagctggacagattcaaaagatcagatgttgcaaaacaccttggcaagaacaacgaatttagcaaactagttgcagaagaatatctgaagttttttgattttacaggaatgacgctggatcagtcactcaggtatttctttaaagcattctctcttgtgggagaaactcaagaacgagagagagttttaatacacttctccaatagatatttttattgtaacccagataccattgcttcacaagatggagtccattgccttacctgtgcaataatgcttcttaataccgatctacatggccacgtaagtaatattggaaagaagatgacctgtcaggagttcattgcaaatctgcaaggggtaaatgagggtgttgatttctccaaggatctgctgaaagctctgtacaactcaatcaagaatgagaagcttgaatgggcagtagatgatgaagagaaaaaaaagtctccctcagaaagtactgaggagaaagctaacggaacacatccaaagaccatcagtcgtattggaagtactactaacccatttttggacattcctcatgatccaaatgctgctgtgtacaaaagtggattcttggctcggaaaattcatgcagatatggatggaaagaagactccaagaggaaaacgaggatggaaaaccttttatgctgtactgaagggaacagttctttacttgcaaaaggatgaatacaagccagaaaaggccttgtctgaagaggacttgaaaaacgctgtgagtgtgcaccacgcattggcatccaaggccacggactatgagaagaaaccaaacgtgtttaaacttaaaactgccgactggagggtcttgctttttcaaactcagagcccagaggaaatgcaagggtggataaacaaaatcaattgtgtggcagctgtattttctgcaccaccatttccagcagcaatcggctctcagaagaagtttagccgcccacttctgcctgccactacaacaaaactgtctcaggaggagcaactgaagtcacatgaaagtaagctgaagcagatcaccaccgagctggccgagcaccgctcatatccccccgacaagaaggtcaaagccaaggacgtcgatgagtacaaactgaaagaccactatctggagtttgagaaaacccgctatgaaatgtatgtcagcattctcaaggaaggaggcaaagagctactgagtaacgatgaaagcgaggctgcaggactgaagaagtcgcactcgagtccttcgctgaacccggatacttctccaatcactgccaaagtcaagcgtaacgtgtcagagaggaaggatcaccgacctgaaacaccaagcattaagcaaaaagttacttagagtccatctgcggccaggaagtgctggtcatggagcaaaatagggtttttcaagatctttctggtaatccgtgaatatatttaaaaaaaaaaagtctgtgacaaaacggtgcattagtaattttttctattgtatatttttgttagtttctgtacagattgtctttgctcttgatttcttttgctttgatgatttttgcaacttgatagctaatgcaccttttctgtgaggaggaggggatcgtgatttcagaatgaattatgtatcccttctcttttggttttctcttgtttgcagtctgctcagttgttttatgtattctcatatcaactgttaaacttttttttaaggttaaagaatttaatccattgtgaaacacttaactggacaaactgtagttttagtaaattctagctggagttaatatacgcctttatatgtgaaatcttgcccagtcacagaggtagaattgagcactcacagatgctccagtaagaatcacagtgctgggaatctagttgctccaatatgaggcagcttcatgtgcagcttagcacttgttgttgagatcggaccctgctggaagcagggaaaagaagcgtgaagatcgtaggattgagaacttagggaagcacattagcttgcttgaagtgctgattccatttcagccaagcaagggaaagaggaagtggagtcattttgcctttgaaggctgaggaaagattgatacccagttaattttgtttgctaaaggatgggggcaataatcggcccttgaggagctgcagcagtaggcatgtgctcagtctgcaggaattgttacctcactcccacagggtctagactagaaatccatcatctctatcgttgatatccttccatccaggaatagatttttcttactctacatatgtgtgtgtgcgtgcgtgtgtgtgcgtgtgtgggcatggggttgtgtcctggttgtgatattgaggtcttccttcctaacaaattaatactaaaatgaaacagcttttcttgtgtccttaagacaaaataaggaaggaaaacgtagctgcagttgtccacgatggatattggttctttaaaatatatctgaaagtagtagtcagaatgaattatggttggaaaactgaggaatcttctggttgcaggtgcaaagtgactttgtttattcttgtctcagtctccttgatagccacttcactctgctactactcaactttctcctaaaaatacttcatctattttcagtcctttctttctgtctactcaaaatggttctattaactttgcagtcatgagcttgttccagttacagtccctttgaagttcagggtgataaacagaatattcttctgtagaggaagagaaaggagtgaaagtttagcccactgagacctagagctttgtgatttcctaaccttgaaactctgtaatccctaaagttaaaatctccgcaagtggcacaacttcagaactaatagtatcactttgatttttctttttcctcccttagaaagtttctctagttctatagtttatttgttgaaggtactatgaccaaagaatcagctgctctacaggaatagcatggttccagtgaattagagaaaacctgctgtaaagccatggtagtgtctaagtggtatgttattatgatgtactagcatttatttacagaattatttattaacgtttacttccttcccctctgtaaatgtccatgactattgcccagagaaggcttacccctctctagggttgcagttgctttctttgtaataagtattttgccacacctgtaaaaaaaaaaacctcacttttaactctctgccttgtttgggtaaaggcagtaactaagtttatgtttcagaactgcaaaacaaacaggatagttaccaatatggcccatgtatcagattgatttttgtagcctctcactgaatccaacatatccacaagcaagttatctgtctttctacctgataatctaaattatcaggatatttgttttctgcctaaatgtttatactaagccgaggggagagaggtacctagaccatgtcatctacaagcttcagtaactaaagaaaaaggaacttccctgagtggcttgaatgtgtttgcccacagtctatatctatgtatatagaatgtctgtatgtattttacttatttaatatacattgaatggtaccttgctacagtatttctgacatttagagtagtgttgaaatactcggctagcatcagcaccactatagcactgtccgtgtcatatgagtcactaatattaactccagggacttctggataggctaatagatcattggatacgaagggctcttttgaagcttcagtataccatgtttgcatagtttatctttaaaaacaactttaaaggttcttttgtgagccaggatctcagactgccgtagcatgatgctgtccatctttagcgcatgggctgagaacacctcttccctgaggcttctgaaggttgctgtctgtcatgagtgcatgaaggaggccaagagtttatgctatgggaggaaacagtcactgatttgcctagattctgagagtctggcccatagccaaccacattttcctttgggataatttatttcctgtggcatctagccagaagaaattgaggatgtttcctttcacagctgctccaagcctgttgcccaattcacggtacaagggagcaccccttccctttcctctgaaggtacgccacccacctccgtcgcccacctcagcgcccaggagccttgggacttccttccatatgataaatcattcttcttcacgtcaatacacttcatattaatttctagtacagaaaatcttgacagctatcagaatgccttggtcatagtgttgttgcaaaattgaccatacaggtggcccatgtataaaatctgaattttaggggtttgtccccacctcgcatgctggcttttacagggaggtgtctgggattcctcattagcaatcaaaacttaattactgggatgcagagtccttactttatcgccagcccgtaggcatttctgaagtgcacttttttgaaacatcattttgctaactctcagcagtgtctaattaaactgagcaatacttttgtgaattttaattaatctcagcaaaaccatgatgggagagagtcctctgatggaaatgtagtccctggattatgtgtaacctttttattcctcttagatgcagaggatagaaagcattttttggtgcagtggtcttgtggcaaacacaagaccctctatgcgtctccaactgttatcctaatctagaaaatgaggactggcccctgggcaaaagtgacatgaggaatttactctggaagaggaaaatctgggtggctttccaaggctaagataggtttgtatttcaccctgtggccaagctacagaacttctgagattgtggaagaatttttgcaaccagcagggaaagaggcctcttactgcctaaacacaaagttacactgagcttttctactgtcctttgcctattgctccctctatcatgtaaagatctgggaaggatgagaggcagggcctgcttgtcatgagctgcactcttttctttttaactaatcattgacaattggaagaaaattgacgttaaagaagtttctccattgtcttactaacaaaaccttttgggtttcattaattgtccttgaaattgagttcctttggcatttttccttgcagtcatcagttaagcatgttgcatcctgaattcacagaagtttagctttgcaggtttgaatctctgtaatttaactcccgtggacttggtcgagttttcagcaggttgggagccacctctcttcatttcagcagtgagtcatcccttgacttttcaaatgacagaattttttccaattgtaaaattagcactgtaaaacaaagaaccaaagtggcatcctaagagttgttaaacctgaagtctagtttatgaggaattgtccaagttggagtttaaatagtatctgcttttgtctcaaagcatctaagttattctgacagaaaatggtaagtcagctttgcaggcagatgcgcctctgggcctcctaccttgctccacagctttctggccatcttgtctcccaggccatgccactgctctgccacatgtcagcaaatttctttccaccagtcttatagcatcttacatgatcaaatcatcacagaataaccccgtgatagattattgatagcaatagagaggggctttgtcactgatttttctctcagattccttttccatctctcatccataaaggaaggactgaaatccaaaggcattctccttttgtacctacagtatccagaacccacgtgggcagccttctgcttatgacaataattggcccattgcatgcagagagaatgtcttcatagagagaatgtcattaaatacttgaatctgcatgacagtttgacttgaatgcaacagcaggaaaattttgcaagttacataattgtatatacagtaggttttcttaagtctcttcggttcatcctttgtaatttgtgtgtgtatctgtagtattgcaggcttttggagactattcttacaggcagtatgtcagtcatcaaagaaaatgctgtcacctgccattgttgtatttgtgggtatttatagttgtatgtatgtaaatgcatcagtgtgtagattgcatatcagtgtatggtacatgtacatcaaaattatttttgtccttaatcagtgtgatatgaaaagcaagtacaacctcataggactgattatataatgaagttgttgagagtatatatagtggtattgttttattaaacttaaactcaaataatattttgattaaaatttttaataagactttatgctagaaaattctttgagctttgaatcaccagggcaaaaatgactttcaactaaccttgtgaatcttttgcagtgtactgtgtgcaataccaagggcatagctccctgtaatttgggaaatacagaaagaaaagaaaaaaaaaaaaaaaggcagcctgtgcagtcttagtaactttagtattaagagcacttaaagtcaaactgacaattttgggcttattacaaaatgtgatgctttaaagcacacgttctttattgttgttgtaattagtccataaaaaatatagctttcggaagaattaagtacccaccatatcatttatgtatttgtgtatgttttacgggagatcaaaccactctcgtggtgccgcatccgtactcgcttgacttggaagaaatatcacaagcactaaagtatatcagggcatcccaggattgggtactgtatcctaggtttgcagttgcagaaattagcatctagtgtcacaggtaaaagaatttcaggaccaggtttaaactttattttaaatatttttatacttaggtctctttttcctgcctctccccaaagaagagccactggccttagttgtttgagcttactgcttatattatagagtgtaaataggtaactagagactaaaattttattaaccagcatgtttggtatatttaaagcagtgactgagtgtgtttgagtgagtggctgagtgcagtgtcttttgtttaaacacactgcctcgtgtctttgtagctgattcagagagtttgaattgtggggtgggagactaacttcagctccaggctgcagtaatgtgttggtagttacacttgaggcatttttttgttgttgttaattaactctatagtctcaaactatttttgcaaatatatcatttttcctaattggttcttgacgtgcagtggactggctctgtgaatgattggcagggtcttagttttgcgagagtatttccttctaagaattattgtgatctgcagaaacagccatttgattcaaaaatcatgtagaaaaggagtaggagaagcaaaacgtttcatttttgggccttaaccatttgaaatgtttggactttaaacataaagccatggagtttataaagccaagtaaccatttgatatggataataatatctactctagagagagtatatatatgcacattgatttttaatgctgttaagatacttttgtaaaactgtaggaacaagagtaattagaccaaattgaagcttaggggacagtaaagtggttgctttccatttagggtaaccatgcatgtggttagtcctctcctcctgagattcagaaccagttgactgtccccttaggtgtataaggagaaaagttgacatgtctgggacctctgacatgtgtacacatgcttgcacacatgcacacacagtgaatgttttaagttatacaaacataagaccttaagatgcaaagagccagaatattctaaagaggtgatgaacagagggggtggaaactgcatcacagatgttttccaagggccagggtggaatctgagctctagtgtctgactttgagatgcattatatttttaacacataaatgaggggatccatatcacattctttcttgtggaccaccaaattgaaggctttcttgtaattcacaagcagcagctctccagcatctctccgtagcctgggtgaagtcccagaagctggtgtgcatcattttccaaggtggcagagctgcttgctctgcagatcattcctttgagagaggagtacaagtgaagaaacaaggaggcacttcctgtaggagcactgatgtgccttgtccacactcccctctgagctttactggtaagagagctccgactgaacatgctgagcagttgagcacttttccatcagcaacaacagcgaggatggaaatggaaaggaaccgaactaaaatgcatttccctttgcagggcagagagctaagctcttaggaatagtgttatagaaataagcaccctaacttcaattcctgaaaatgttggttaatggagagaattttggagtttcacttaatattttcccatcggtcgccataaataagtcttcaggcgctcctagaagagtcccagcccaaggctcgattaaggaccacactgcaggtctgaggctcactgctctgagtcctgaacaccagagccctgcagagagtggtgataacacatcatctctgcaaagaggaacctctcccccggccgccacttcactcaggcttctactgagcagcaaggacagcctgggtttcaaatgccacttcccctgctttagggatccaggtgtcctgatagcgtgaccctgctgaggcaaggtatcaactccgagagtgactgagtcactgagcgtggcacatgaacaaacgtcatgacaaagattctctgagtgaagttaacaccacgtattttacctttgcaaaaaacaaactggcaccctgagttctaactacggacggacgatatctttgcctccacacccagattcctggaaatggctaacgtttcctttctaggggaagggtcgaggaatactcaagtgctagcttagcagctttgttcagtccagatcagagctgttaggtaaaggcctaaccacctccctgcagtctcttatatctcaagctttaggaacccatttctaaatgtacactagcggagaatttatattgtcagccttgattaccataggacaggcagaaaggcgataatttgtatcttttaatataaaagaagcttttaacttttccagcctattataataactgagttatattcactgtggctcaaactaattggcattgtggaacatttctttaccttcaaagttttctccaccaatcatttcagttctattgcagtcctggtgccatatgtcccctgcaaattgtgaaagtaattagtgacaaaatagcagcctgctccttttcaatggcgaaactgtcggcattagcagttttgggtaagctggcggtactataacacgtactggaaacctgttcctcatcaccacctaccagattctggaaatgccgtcttctagaaaacgatggcgtttgtggtggtcttcttttgaaaggaacagtaatttgtgtggatattgttaaagtgtttaaagaatattttgacaattaagtttacattttacaattgctttattttttattaaaatagttgtatataaatattaccctatttcactgttgttcaagtaaatctaaaccttgtagacaagtgagtcatctgatatgtatagaagctgtgatatatagagtacatttattgtgtaaatgtttatgaatataattgttcctgtgtttttataagttggggatattttgttgttttacggcaacaaaatttattgcatttaaatggtttttatgtaatagaaatcacgcaaaatagtgaaggatttaaaatatgtatatgatacatgtaaatgtacaaactttagaaagaaataaatccaacaaatttcaatca

SEQ ID NO: 22698 - DNA, 5188 bp, Homo sapiens
acattcactgggcaagccgactgtgagccaggaagtgctcttggggagcccaggccaagccatccattcttgggtcctttggagggtagatatggattcccagtttctccagcggccagtgctccccctagtccacacagtgagaccgtgaaagcagatgctccggggcactcctgggcagcttttgctcagtggatgatgggtgactacagactccctgaccacccccagcccatggaaattctcaacctgtacttgggagacagcctggagccccacccaggagagtgcccaagggaaacgtgcagccatgaggatccaccggagcctttcgaggagcaaacctgggccactgaccctcctgaacctaccagacaaaatgttcctccctggggctccggtgtggagctcacacacctggggagctgggtccatcaggacgggctggagccttgccaggagcaaacccgggccactgaccctcctgaatctaccagacaagatgctcctccctggggctccggtgtggagctcacacacctggggagcccctctgcccagagggagcacaggcagaacacagcatcaccagggtcaccagtgaacagccatctaccggggagcccaaagcagaaccggagcacgtccacacaggtagtgttctgggcaggcatcctgcaggcccagatgtgtgtcctagacctggaggaggagctggagaagacggaagggctcaaggctgggctgaaatgctgtctccccacgccccctgtggacctccccggggacacgggcctgcactccagcccacctgagaatgaagactcaggggaagacagcagtgagcctgagggagagggccaggcatggctgagagagggaaccccagactcttccccacagtggggagctgaggaggagagcatgttcttcagcaaccccctcttcctggcgagtccttgctcagagaacagtgcttctggagagtgcttttcctggggggcttcagactcccatgcaggtgtgaggactggacctgagagcccagcgactctggagcctcccctcccagaagacacagtgctgtgggagctggaaagtgagccagatttgggggacggcgctgctatcagtgggcattgtacccctccattccctgtgcccatctataaaccacactccatctgctgggcctcagtggctgccgctgagggggctcctgcagcacctcctggtcacggggagagtgagggagataggcttggtcctgctccatctgcagcaccgtgtgtggacgaagcattgacctgggaatcaggatgtgtcggatctgatcttggccctgctgcacatcctgtgcaaccttgggcctctctcagccctgagggctggcagagaggaggtcctttttggccccaggtgactcttaactcccaggacagagatgagagggagggtggacacccccaggaatctcttccctgcaccttggccccctgcccctggaggagcccagcttcttctccagagcctagcagcccagaatctgagagcagaggccctggtcccaggcccagccctgcatcgtcccaggagggcagcccgcagcttcaacaccacagctcaggcattttgcccaagtggacactagatgcttcacagtcttcactcttggagacggatggggaacagccaagttccttgaagaaaaaggaggcaggggaggccccaaaaccaggcgaggaagtaaagagtgaaggaacagccaggcctgcagagactggagacgtccagcctgacattcacctgacttctgcagaacatgagaatctgaggacaccgatgaactcttcttggcttcctgggagccctatgccccaagcacagtccccagaggaaggccagagaccaccagctggagacaagctagctaatggcgtcaggaacaacaaggtagcctggaacttggcctcacgcctctatcgcctggagggcttccggaagtctgaagtggctgcctacctgcagaagaacaatgactttagcagggctgtggctgaggagtacctgtccttcttccagtttggaggccagagtctggaccgagccctccggagcttcctccaggccttggtgctcagtggggagactcaggaacgggagcgaatcctctaccagttctccagacgcttccaccattgcaatccggggatcttcccctcagtagattctgtacacaccttgacatgtgcaatcatgctgcttaacacggacctgcatggacagaacattgggaagagcatgagctgccaggaattcataaccaacctgaatgggctgagggatggcgggaacttccccaaggagctgctgaaggccctctactggtctatccgcagcgagaagctcgagtgggccgtggatgaagaagacacagccagacctgagaaggcccagccgtccctgccagctggcaagatgagcaagcccttccttcagctggctcaggatcccacagtgcccacctacaagcagggcatcctggctcggaaaatgcatcaagatgcagacggcaagaagacgccatggggcaagcgtggctggaagatgttccacaccttactgcgagggatggttctctacttcctgaagcagggagaagaccactgtctggagggggagagcttggtggggcagatggtggatgagcccgtgggggtgcaccactcgctggccacccccgccacgcattacaccaagaagccgcacgtcttccagctgcgcacggctgactggcgcctctacctcttccaggcacccactgccaaggagatgagctcctggatcgcgcgcatcaacttggctgcggccacgcactccgcgccgcccttccccgccgctgtgggctcccagcgcagattcgtgcggcccatcctgcccgtgggccccgcccagagctccctggaggagcagcatcgatcccacgagaactgcctggacgctgccgcggacgacctgctggatctacagaggaacctgccggagcggcggggccgtggccgcgagctggaggagcaccgcctgcggaaggagtacctggagtacgagaaaacccgctacgagacctacgtgcagctgctggtggcccgcctgcactgcccctctgatgctctggacctgtgggaggagcagctggggagggaagctggaggcactcgggagcccaagctcagcctgaagaagtcccactcgagcccgtccctgcaccaggatgaggctcccaccacggccaaggtgaagcgcaacatctcagagcgcagaacctaccggaagatcatccctaagcggaaccgcaatcagctgtgaagccagcaccacctcagagacactgttccctgctccagggtagacctgagatgaacctccctggaggagacttatttcaatgagtccaccatgacggatgaggcacctcctttccctgctgaaggacaaaccttgtttccctgtggccctcattcttgtgctccctgaagctttcctaatattgctgtgctccccaccacccccatggcagtccctccgcagccccagtccctggccacgcccaagggaagagggaggtgaggacttgactttcctcccagagctcagcccatgtcaccctccaggccccagaatccagagtggcctcatttcctagacttgctgagaactcagcacttgtttgagaaccagtgcttatgtggtgtgcccttggcttctgggggagagcttggggcagcagaggcccctgggcagcccagccaggggagccacagccccaaggatggtcttgctctgggaattaggtgaccttcctggggaggccccaggagagtgaatcagggactcttgagaaattcctaaccagcctcctgtgacccagggagcagggtcgctaaggtcctgcccactgaggggacagccttctgggcagggacctcggggggcttcaagggctctgcacggctgtggggccctgtgcctttgtctccttgtgtctcctttcccccgaagtagatgaaacagtctcacatacccaactgctcatcaacagagcagagctgatggcatgagtgagggctgggcggggtggggcctccagagctttgcagggaaccctggaaccctaggaacaaggagcctttgttccaacagagcagagaaggaggttctctatgttcagaccactggagaggatagagaggtaaaaggtggcgacagtttcccttaggggtctgcctggcaggagccacagctcaggagagttgtgagggatgggacggaggctggcgaccaggcgaggcctaggccaggctcgggagacttttctgtgctcctttctacacatgccttaaaccttccttcctgtggggtgcctggaccccttccccatctctggcagctcagagggtctctgctgctctcccctgggaaatcccctcatcctgccctctggctgcctcccagctgggcttgttctctgagggaggttccggagactcatggacttggggctctgcctgtaggaaggaggctgggccggagggaccagccaccattgtctctgttcagccaagtgtgcaagtaggctgcccgccaagagggggcctctgctacccgctgctgcctgccggctgacacactgcctccccagccttcctgctaggccaccctcctcccttcccatgcttgtaaccagctctggggcttgcacctccacaaagtaaggttggcccttggaggccatgtttgggtctccggccagggcctagggctaggccatgcacccaatgggtgcacaataaataacaggtcaacaaagagggaggtgtgtcagtgtgtgaggaagggaggtcaggcagctaggaccacctgcagtgtggcaggcttcatccctctttgctccaagtgtgtatgtgtgtctgtgcatgtgtgtagtgtctgtgtctgtgtgttcatgcatatgcaggagtcacacggtcataggccatcaaagctggaggagacctcagaatcattcattcacctacttgctcatttattcattcattcattttgcagataatatgggacgctttctatgtgccagtaccaggggattcacaaatgaattaaacatgtccctgactccatgagttgacaa

SEQ ID NO: 22699 - DNA, 3791 bp, Homo sapiens
gtgcgcagtgcgcgggctggccgtcgcggacgccgctccgggcagccgagcctctgtgggagccggggccgcggcggcgcgggtgctccgggccgaggccgcgtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctg

SEQ ID NO: 22700 - DNA, 3809 bp, Homo sapiens
gtgcgcagtgcgcgggctggccgtcgcggacgccgctccgggcagccgagcctctgtgggagccggggccgcggcggcgcgggtgctccgggccgaggccgcggtaaagtttagcttgaatgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 22701 - DNA, 3759 bp, Homo sapiens
ggggacgcgtgcgcagtgcgcgggctggccgtcgcggacgccgctccgggcagccgagcctctgtgggagccggggccgcggcggcgcgggtgctccgggccgaggccgcgtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctga

SEQ ID NO: 22702 - DNA, 1737 bp, Homo sapiens
attttacattgagtcagtgatccatttgagttagtttttttcctcatagacagtcgattattccagtcttgtttgttgaaaagactgtcctttctctacaaaattgccttggcaccttggttgaaaattaactgttctctcttcctgtttactagaagaatttttaaaagaccggtgttatttttttccttaagggattggtagaattcacatatgaactatttctaggctttgacttttctttttggggttttagtagtgaattcatttgctttagtagaaataggtacttcagattttcttttttgtcttgtgtcagttttttcaaagttgtgttttttcaaagaatttgtttacttctaaattgtcaaatttgtttgcatgaattcttattacccacttaatgtctatagggtgtgtagtgtgtacttcctaatattggtgatttgctttctctctttcacttggttcacatagctatagatttatcaatttgatcttttcaagaaacagcttttggttttaatttgtattgtttgttttcaattttattagtttcttttctgatatttattattccctttctattttgggtttactttacctttttctagctttttagggtggagtttatgccattcatattagaccttttctaataaaaatatcttaagactataaattttctttcaaaatcacctttagctgcatactacaaattttgacttttaaaatttttcatttagttaagaatgttttctgatttcccttttgatttcttcttttacccatattttatttaaaagtgtattttaattttcaaatagctattcaggtgataatttcatctatagcactaaaaaccaatgaaaattctgacatatatttgtttataaaattccttgaatgctctgtatattgtatttatatggtatatacctgagggcttttctgtagcataaaagaacagttcattatttttcactgttctctgggttgaaggagctcatttgggcagctccatcttgggggtctctctcttgtagttgcagtcagatggcagctggaatgagagtcatctgaaggcttgactgggctggatggtcaagatagcctcttcactcactctgctagaatgactgggacagctgggtgtgggctggtcacctctctccgcacagcttcttcatgggactagttggctttcacacaacggggcagtctgaaggcagtcagatttcctacatgacagctgacttctagagtgagcattctaagacattgagttttttcaagtagataatttatttgctctactctttcaaactaagaagtaagataaatgtatggggccagtcattgtagaaactgcctgtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattaca

SEQ ID NO: 22703 - DNA, 1632 bp, Homo sapiens
gtgcgcagtgcgcgggctggccgtcgcggacgccgctccgggcagccgagcctctgtgggagccggggccgcggcggcgcgggtgctccgggccgaggccgcggtaaagtttagcttgaagaacgcggccgcgctggagcaggggtggtggacggggccaggcgcgaggtggcggcggctgcggggctgcgtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaa

SEQ ID NO: 22704 - DNA, 3649 bp, Homo sapiens
agtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctgagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttctttaaaaaagaaagaaaaaggaaaaatccaaaatatctcagtatcatctgtctgaagcattgtgtgttctcattcgggtggtaacaatgtatgtgtaatatttttttcttagtgattttgacagtttaaatgtttaacaacttaaagcattaaaaatgcttattaataactttggtcatttaaaaaatgctacaatgacttcctattaaaggttcaatatttacacattcttattggttgatattaccacatgaaatattgccagaccaagatacctaaactcatgatgtctgtggtgctgtaaaatttatactaaaatgtggactattttgaaattataaccatttttgatgccctgaatcttgaggtgacttattttgcatagaggatatggatagaccaacagtaagggttgtgggttataccggcatagagaaaagaagaaaactagaattgaaacaactgtgtcttagacatttgtttgaaaaagcttcatcaggccttggagcagtcactgctttattccgcaaaaattatttggtaggaaatttttgggagatctgattttcttatccaagttttgtaaatagttgttatttctatatttggattggtgaaagacctcaagtttatatgtaaagacataactgcccttagtcatgaaattgttgtgacctctactttttgtcactaatagcctacattcaagtgcctgtgttttttcatcttgtttaggaatgttttgagattaatgtgcttaaaagtcctacgtgactgattttaaacattgtgataaaattaattttcagtagaatagttgaatgtgttaagataggattttatgttagagataccagaatgctggtattctactacttgtgcaatatatatgttttaaaaaacaaatttgagaatacatttaatcatagggatatagatataagcacctctctaaagaatctttagtttccgacgttgaattatagaccagtttgagtaagtactgctttttttttttggagacgggctctcgctctgttgctcaggctggagtgcagtggcgtgatctcagctcactacagcctccacctcgtgggttcaaacagttgtgctgcctcagcttcccgagtagctaggattacaggtgcatgccaccacacctggctaatttttgtattttagtagagatggggtttcaccatgttggccaggctcgtctcgaactcctgacttcaggtgatccacccatctcagcctcccaaagtgctgggattacaggcgtgagccaccatgcccggcccataagtaccgtttttgaggttcagtcttaaacatttgctttaagaaaacagtcttgaatttcacatgctgctatttttatattttgccattttacagtactgttttgttttgaattcatgcatatcattgaaaatttctcgttttcattttcttagatgacttcttgtctgagacagaaaaatttcctactacagcagtgcagtccagaggttaagatgtattagaattatacaatatcagtttaaaaatctgtatgcataaagaatgcaccactcaacttttttattcataagctaatatttttttaaagttacattaagattttttctcttttgcagctacatttgaaagtgatagaataaagagattttaatgagttatcactttttcagctgatatattcattttaatggcttttttgaaagttcctttttcatgaacacacccgagaaatcttaaatagacactttgcaatatttaagaacctaatgctgtttaattttggtacagcttccacattgcatgttcactttagtatttgcaatttgatatatttcatggtggcaaaatattagctctgttttgggacattttaaaatagaactatccttgttcgatagcataggaaaatgttctggtgattgtcagggtctcctaatatttatctcaattcttttataagtctatggaaattatttaattattttaaaacgtacacacttttcttgtaaatatgtcacatctgagttcaaaaaaattactttgaataccttaatatttgctgcatttttttccgtatatataacatgtcttctttcagaatgggaatatatgtgtgcctcccaacatttactgttaaagtgtgttatctttatatgtcaaactggttgaacactgtaatgagaataaactgcacagagtttattctg

SEQ ID NO: 22705 - DNA, 1753 bp, Homo sapiens
aaagttgctatgtcattttgcatttccaccagcaatatatgatagttcgtttatttcacatctttgacagcatttagtgttgtcagggttttttttgtttgttttagacattttagtagtctggctcttgctgattgaattcctttggtgcagtttagcatgttcctctgtgttctgcatctcctgtagtgtaatgttcaagctcagaaatgccttatgtggatcgtcagaatcgcatttgtggttttctagacattgaagaaaatgaaaacagtgggaaatttcttcgaaggtacttcatactggataccagagaagatagtttcgtgtggtacatggataatccacagaacctaccttctggatcatcacgtgttggagccattaagcttacctacatttcaaaggttagcgatgctactaagctaaggccaaaggcggagttctgttttgttatgaatgcaggaatgaggaagtacttcctacaagccaatgatcagcaggacctagtggaatgggtaaatgtgttaaacaaagctataaaaattacagtaccaaagcagtcagactcacagcctaattctgataacctaagtcgccatggtgaatgtgggaaaaagcaagtgtcttacagaactgatattgttggtggcgtacccatcattactcccactcagaaagaagaagtaaatgaatgtggtgaaagtattgacagaaataatctgaaacggtcacaaagccatcttccttactttactcctaaaccacctcaagatagtgcggttatcaaagctggatattgtgtaaaacaaggagcagtgatgaaaaactggaagagaagatattttcaattggatgaaaacacaataggctacttcaaatctgaactggaaaaggaacctcttcgtgtaataccacttaaagaggttcataaagtccaggaatgtaagcaaagcgacataatgatgagggacaacctctttgaaattgtaacaacgtctcgaactttctatgtgcaggctgatagccctgaagagatgcacagttggattaaagcagtctctggcgccattgtagcacagcggggtcccggcagatctgcgtcttctatgcggcaggccagaaggctgtcgaacccttgtatacagaggtatacatcaagagctggtgaatgcagcacgtatgtgggctctcacgcaaacgtgccttcttagtggagggcccagacttactacttacaactgatcatagaaagagcatccccccggtccttcagaatccaaacacgctttccgtcctaccaacgcagccaccgccacctcacattccacagcctctcgcagcaactctttggtctcaacctttaccatggagaagcgaggattttacgagtctcttgccaaggtcaagccagggaacttcaaggtccagactgtctctccaagagaaccagcttccaaagtgactgaacaagctctgttaagacctcaaagtaaaaatggccctcaggaaaaagattgtgacctagtagacttggacgatgcgagccttccggtcagtgacgtgtgaggcagaagcgcacggagcctgcctgcctctgccgtcctcagtttcctttcatgaggcttctagccaaagatgataaagggggaaatggtttttagtgcgtatattatactgcctcttaggtgtactctttataagctggtaaaccaagaatctagggagtggccaaactaaatataatttcttt

SEQ ID NO: 22706 - DNA, 5638 bp, Homo sapiens
aatgcgaaacgtaattaacccggaaaaaagagccgagggacgggagagaaggagggggcactgggggagaccagagcgaggggagcgagaggcgcggagagtttggcaggcagacccagaaatccctggagcgcggcggacccggcggccggaggggcgaccccgcccgatgtaacgcgccccgcccgagccccggcccctgcacggggggggtgatgtgagcagagcccaggaatgccttatgtggatcggcagaaccgaatctgtgggtttctggacatcgaggagcatgagaacagcggcaagtttctgcggaggtacttcattctggacacccaggctaactgcctcctctggtatatggacaacccccagaatctggcaatgggggcaggagctgttggagctttgcagctgacctacatctcgaaggtgagcatagctaccccaaaacagaaaccaaaaactccattttgctttgttatcaatgccctgtctcagagatatttccttcaagccaatgatcagaaagatatgaaggactgggttgaagccctgaaccaagccagcaagatcaccgttcccaaaggtgggggcctacccatgaccactgaagttctcaagagcttagcagctcctccagccctggagaagaagccacaggtggcctacaagacggagatcattggaggggtggtggtccacacacccatcagccagaacggtggggatgggcaggaagggagtgagcccgggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggaccgagaaccactgcgcaccatatttcttaaggatgttctgaagacccatgaatgtctggtcaagtctggtgatctcttaatgagggacaacctgtttgaaataataacaagctccaggaccttctacgtacaggcagacagtccagaagacatgcacagctggattaaggagattggcgcagctgtccaggccctcaagtgccaccccagagaaacgtccttttctagatccatttctttgacccgacctggaagctccagcctttcaagtgggcccaactctatcctgtgcagggggcggccacctttggaggaaaagaaagccctctgcaaagccccctctgtggcctcctcctggcagccctggacacctgtcccccaggctggggagaagctgcttccacctggagacacttcagaggactccttgttcacgcctcgtcctggggagggcagcgcccctggggtgctgcccagctcccggataaggcacagatcggagccccagcaccccaaggagaagccgtttatgttcaaccttgatgatgaaaacatacggacctctgatgtgtgatggagcacagtgccatgggagggagggagggagggaggacttgagagaaggaggctgtgactcagtttctctaccttgttggagggtagtcagaggcctttatgtcactcatattcctgtggatgctctttgggagggaggggcccatccagctgggctgtgtgtgtgtgtgtgtgtgtgtgtgtgtgtgtgtgtaatatcaacgcagtgtatttaatttggggaagtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaatgggccagcattagtctaattttaagcgctatgtgttttgtacccttgcaaacttgctttctctttcttcttgctgttgccctttgaatgaagccttgtgtgcttgcatgatcagaccctgtaataggatgaatttccatgcacttaacatgaagagatacaaaaagaatctagagagagatatatatttttaatgaaatagaagcttggcatagaaacattgatttagatgttatgagttgctggccagagattcctcagataaaagagcctagaaaattgagttttgagcgggcatggtggctcacgcctgtaatgccagtagtttgggaggctgaggcgggtggatcacctgaggtcaggagttcgagatcagcctggccaacatggtgaaaccccgcctctactaaaaaatatgcaaaattagccgggcgtggtggtgcaggcctgtaatcccagctactcagaggctgaggcaggagattcacttgaacccaggaggtggaggttgcagtgagccaagatcgcgccattgcactccagtcagggcaacaagagtgaaactccgtctcaaaatataaaagaaaattgagtgtcccacccaaattttagggcgtacctccttccatttgataagaagatgctatttccagtgtccctgggagaattcttccatccagtttatatggtgaattgccaccagcgttccctaaaggaagagagaacttagcttatttctgtctgtgacttttatcagctagatcagttaattgtatttttaaattaaaaattagtaactagaggaagagactaagagaactatttttacctgagtaaatgctctcctcttcttgtgtccaaatctaatgcagaggtgaaaacacttgatgagaaaatcctttgtggcttgaggggaatcatgtttctttcaggacgtgttgtttccctgaagtctatgtcacactgagaactttttctgactgcactgctttggagctattcatttaaattgagtttggcctagttttcctggtataaaacaggaaatctacattgttccctctttctctcccttccatcccttcccctgcctttcctatacacgctggtgtgcttttgccctcagaaattcttggtttgggagttatgtatttttgagtgatcgaggttatgacatacttggagcggcatgatttcaagaagccattccaaattcttatagctccttagctctggttttactctcgtattttccccaagaaaattttttggctattcaaagaaagcacaaaatatgtgatgtggaactcatgaaaatagggacttttgatatctctttaaatattccctgactcacggaaaagatgtcctcttttggtgtatacattgtgaaaatctacccatttatctctctctctctcttttcttttaaataaattatctgataaggccggcaaggtggctcacgcctgtaatcccagcactttgggaggccgaggcgagcggatcacgaggtcaggagatcgagaccgcggtgaaaccccgtctctactaaaaatacgaaaaaaaaattagccgggcgcagtggcaggcgcctgtagtcccagctacttgggaggctgcggcaggagaatggtgtgaacctgggaggcggagcttgcagtgagccaagatcgcgccactgcactccagcctgggcgacagagcaagactccatctcaaaaaaaaaattatctgataggttactattgctaaattaattggccattataataagctgatttgtttcttattcagcaagatctcttttgagaatgtgacaaattaaacatacatagaatccatatggtattatcctgataaagggaaacgaggacactaagactgtcaaatggaaatcttcttgtcaattggcaaacacttgggaattccacattagagcattgcttgtttttaattttttttttttaatttttaaaagacagggtctcactctcttacccaggctagagtgcagtggtgtgatcatagttcatcataactttgaatctctgggcttaagcaatcctcccatgttagcttcccaagtagctaggactacagggttgtgctaccacgcctggctaatttttaatttttttttatctacagagcctggctatgttgcccaggctctctcaaactcctggcccaagtgatcctcctgccttggcctcctaaagtgttgggattacaggtgtgagccactgcacctagccagaacatcgttaatgtagttcaatatgagataaattattatcttcaatgaaacaagctctaaaagcattccattcctaaattgtatttcaaacttcctattttgttgatatttcttaacttctggccagttttggaccataatcttttaatgtgaaccaaagatggtacgtatttgaccaaagcagttagttttaaatgtataaaattgaaccaaatggaaaaaataggttggggatgcagtatagattagtgactaagtgcataggctctggagtaaatctgagtttttttttttttaaaggaactaaaaaatgtactgcattttctttgtggaataaaagccttgcctgagttgtgctattttcataaggcttttgaagtggtcttgacccactgtgtgtaacagtatttcaggtggtcctccccatggctgaataatgccatccattattctttaatttttatttttagaaacagtgtttcactctgtcacccaggctggagtgcagtggcctgatcatggctcactgcagcctggacctcctgggctcaagtgatcttcctgcctcacagcctcccaaagtactcagattataggtgtgagccaccacgcctggccaccatctattacttttgaaatcttcaaaagacttgcttactcaatgtcagctgatggttggtaaaaataatttggcctttagtgttaagtgagacatcataagggtattgaggtatacattatggagattgatgtcaggtcagaatattggagttatacatctatttctgagttgaatactcagctcccacgagaaagaaagtagttttaaggtccagcttcttagtctacttgaagcaaattttttttcttttatatttctgaatataaatatactcttatatgggctaaaaagaccccatgaataaatagcaggttcagtagttgaggagtggagtttagtaggtttgttttcagtataaattagataacatgtggaggtcacagcattttggaaattgagtgtccccaagtgagctttgtttataaactttcaaaatgtcggaagtggacaggtttgttaaatcttgtctgccagcacccttttcttcctttgttccttttcctctctgtgttattgcctgcggcagccagtccttcatactagatagagttcagataaagcaaacgtttggcaaaaacatactgtttgacctcctccccctctgcttatgaaggggtagcatgattctgtgttttaaagcagtgatgtttcagctgtgaaatgcactcgctgtaagctctaggctgagtgcatggaaactgttacgcttctcattttatgtgatctcctaattggtatgtagcaaaaattttctaaaactgttttgtggcttgttttgtaataaaaccatgtgaaatactg

SEQ ID NO: 22707 - DNA, 565 bp, Homo sapiens
gcagacccagaaatccctggagcgcggcggacccggcggccggaggggcgaccccgcccgatgtaacgcgccccgcccgagccccggcccctgcacggggggcagcgaaacttctctgcgggttctggcgctggggcaccgaccccgcaacgactgcccgggctgcgggaggggaggagagcagagaacgtccccagggtgatgtgagcagagcccaggaatgccttatgtggatcggcagaaccgaatctgtgggtttctggacatcgaggagcatgagaacagcggcaagtttctgcggaggtacttcattctggacacccaggctaactgcctcctctggtatatggacaacccccagaatctggcaatgggggcaggagctgttggagctttgcagctgacctacatctcgaaggtgagcatagctaccccaaaacagaaaccaaaaactccattttgctttgttatcaatgccctgtctcagagatatttccttcaagccaatgatcagaaagatatgaaggactgggttgaagccctgaaccaagccagcaagatcacc

SEQ ID NO: 22708 - DNA, 1749 bp, Homo sapiens
agagaaggagggggcactgggggagaccagagcgaggggagcgagaggcgcggagagtttggcaggcagacccagaaatccctggagcgcggcggacccggcggccggaggggcgaccccgcccgatgtaacgcgccccgcccgagccccggcccctgcacgggggggaatctggcaatgggggcaggagctgttggagctttgcagctgacctacatctcgaaggtgagcatagctaccccaaaacagaaaccaaaaactccattttgctttgttatcaatgccctgtctcagagatatttccttcaagccaatgatcagaaagatatgaaggactgggttgaagccctgaaccaagccagcaagatcaccgttcccaaaggtgggggcctacccatgaccactgaagttctcaagagcttagcagctcctccagccctggagaagaagccacaggtggcctacaagacggagatcattggaggggtggtggtccacacacccatcagccagaacggtggggatgggcaggaagggagtgagcccgggtcccacaccatccttcgaaggtctcagagttacatccccacgtcaggctgccgtgcttccactgggcctcccctcattaagagtggttactgcgtgaagcaagggaatgtgcggaagagctggaaacgtcgcttctttgcacttgatgactttaccatctgctacttcaagtgtgagcaggaccgagaaccactgcgcaccatatttcttaaggatgttctgaagacccatgaatgtctggtcaagtctggtgatctcttaatgagggacaacctgtttgaaataataacaagctccaggaccttctacgtacaggcagacagtccagaagacatgcacagctggattaaggagattggcgcagctgtccaggccctcaagtgccaccccagagaaacgtccttttctagatccatttctttgacccgacctggaagctccagcctttcaagtgggcccaactctatcctgtgcagggggcggccacctttggaggaaaagaaagccctctgcaaagccccctctgtggcctcctcctggcagccctggacacctgtcccccaggctggggagaagctgcttccacctggagacacttcagaggactccttgttcacgcctcgtcctggggagggcagcgcccctggggtgctgcccagctcccggataaggcacagatcggagccccagcaccccaaggagaagccgtttatgttcaaccttgatgatgaaaacatacggacctctgatgtgtgatggagcacagtgccatgggagggagggagggagggaggacttgagagaaggaggctgtgactcagtttctctaccttgttggagggtagtcagaggcctttatgtcactcatattcctgtggatgctctttgggagggaggggcccatccagctgggctgtgtgtgtgtgtgtgtgtgtgtgtgtgtgtgtgtgtaatatcaacgcagtgtatttaatttggggaagtcactaggttagaactgtaggcatactcagtggagaggaagctacctattctattctaactattctgaggtcttcctggagagggattgttttagcagctcctctccagagggggctggaagtccagtttcaccaatgaccaagttttatttccttgtccttgttttagttttttcattttgttttcagtccaggtgcctcgcagctcttttggaat

SEQ ID NO: 22709 - DNA, 2784 bp, Homo sapiens
gaaatcgacgtcggggtcaatgaaaacaaacggggagcccagggggaaggaaggcaggcgaggaagaggcagcgccggggcgccggagggagcagccgggctgcggaagcgcgagcaggaggccggtcgcgggcgcatttttgccgttgtcgcggccgccgccgccgaggcttacccgggaatgtctgggcccgcgcctcgcggcccccaagctccacgctgcgcccgctgtcccggcctctaaaggccgccacgtccctgcggcgcgcgcaggcagaaagcggcttcgtgccggcggagggggcccgggcgggccgggaggggctgccccaggccctgcgcctaccccatcaccgcggccggcgccgggccgggaggatgcgcggtgtggggctctgaagcatggagggggtgttgtacaagtggaccaactatctcacaggctggcagcctcgttggtttgttttagataatggaatcttatcctactatgattcacaagatgatgtttgcaaagggagcaaaggaagcataaagatggcagtttgtgaaattaaagttcattcagcagacaacacaagaatggaattaatcattcctggagagcagcatttctacatgaaggcagtgaatgcagctgaaagacagaggtggctggtcgctctggggagctccaaagcatgtttgactgatacaaggactaaaaaagaaaaagaaataagtgaaaccagtgaatcgctgaaaaccaaaatgtctgaacttcgcctctactgtgacctcttaatgcagcaagttcatacaatacaggaatttgttcaccatgatgagaatcattcatctcctagtgcagagaacatgaatgaagcctcttctctgcttagtgccacgtgtaacacattcatcacaacgcttgaggaatgtgtgaagatagccaatgccaagtttaaacctgagatgtttcaactgcaccatccggatcccttagtttctcctgtgtcaccttctcctgttcaaatgatgaagcgttctgtcagccaccctggttcttgcagttcagagaggagtagccactctataaaagaaccagtatctacacttcaccgactctcccagcgacgccgaagaacctactcagatacagattcttgtagtgatattcctcttgaagacccagatagacctgttcactgttcaaaaaatacacttaatggagatttggcatcagcaaccattcctgaagaaagcagacttatggccaaaaaacaatctgaatcagaagatactcttccatccttctcttcctgaagaaactgaagtgtccaacttcctctaagtattgctatgcaaaagctgctgtaattaaactattgttatagggagtagttttttcccttaggactctgcactttatagaatgttgtaaaacagacaaacaagaaaacaaaccacatacttttgaagtgtattttatctttatatagtttgtttgcaagagtattttcctaataacttcacagtatgaatgtgcatcttttttttttgaacaaatgatggtgtaacattttgacatccataaggacaaatgtagatatttttcttaaaaactctgaggggactgacagcatggtcagggtgtattgtagcttataaacatgaaatcttataaggtttcagtttgacagaagtgtgatatatgtaacttgtgccatggaccaaatggtcactttaccacagctaaaaatgagttacgatagcagcttgatggtgattgtattgtattcctttaatcaaaaaggaaacacaatattctaagtatctttagcccaaataccatgacatattgagcatctttaaataaccagactgtattgtccttcatatgtgaagttgacactactgatttgtcaataccaaattttgggttaaagtgtttaatttttatgtatttattttcttgttgcctcaaaagatgattgcattctaacttttgtgacctaccaaatttaagatgtgtatacgttgttctttacgttgttctagaaaagagattttaatgctgtagtgactttgctcacttacactagagaaataaacaactttcaatggaagagaattttagtgctttttttttcctaaaatagatattaagctgctgttgtaaagtattgtttgcagctctttccaatatctagagacatttttatttatgaatatttatacaaaaaggaattctgtcaagatgactgctctatatcacttgagaatggcattatttaattaaagaacaaatagcattttttggtagtgcctgtccatacctattgtcattgtttgccttgtaatctgtttttttgaattcattttgggctgatagttttgtttaaggttttggataaggagcactttaaaacaaactggtgtgttgtttttaagttaatcatatgtttaataaatgcgtggtttttgcattcaaacacatcatataatacattgtattttttacattcattgatattctgtctaatctttattaggcactaatataattctaatggatttgagtttgtttgtatatttaggcctgctggtgaagacacaaatgaagcataatttttgttgcctgtgagcttagaatggtgtgacctatttcattttatttcaatttatcttgtaagtttatgtgggatattttaaaataattaatatttggtatttgtttaaaaaactgtaattataggccttccatcttaagtttaagatggacataaacagtctatacattaa

SEQ ID NO: 22710 - DNA, 3082 bp, Homo sapiens
gggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacaggcacactctggctcccccacttatctccagctccccccgcggccccctgggacccgggcctccatggttttattgccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaaggccccggtggcccggccccggatgagtgcccaggagcagctggagcggatgcgcagaaaccaggaatgtggacggcccttccctcgcccgacctccccccggcttctcaccctgggaaggacactgtccccagccagacgccagcctgacgtggagcaaaggcctgtcgtaggacactcgggagcccagaaatggctcagaagctctgggtcctggagtagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaactttt

SEQ ID NO: 22711 - DNA, 2786 bp, Homo sapiens
gggaaagaccagcagagaggaaagagaaactgggagagggaggaagggagaaagtgagaagggaaatcggaaagagaaaagggaggaaacggcagagccagagagaaagaggaagagactgagtgtgaaggagagaggacacaggggatgactgagagacagagagagagagagagagagaatgagacagagacttaaggaagagaccctgtgagtctgacaataaaagatttggacagaaacagaaagattggagagagagagagagggagagaatgagtgagagagagactggaagagacagagatcagagggagacacagaaagtgagagtggggagagaggtagtgtaaaaggaagagagagagagagagaccgtaagagacaggagacaaagagacaaaaagtgtgagtgagcaggtgaggagagagattgagaactatgagagacagcagctaagagacaaaggaggcgggagactgcctaggtgccgcagcacccacaccgtcctcttgcccccccgtcactgggaccccagagctggcccttgatggaggggagccgacctcgcagcagcctgagcctggccagcagcgcctccaccatctcctcgctcagcagcctgagccccaagaagcccacccgggcagtaaacaagatccacgcctttgggaagagaggcaatgcgctcaggagggatcccaaccttcccgtgcacatccgaggctggcttcataagcaggacagctcggggctccgtctctggaaacgccgctggttcgtcctctccggccattgcctcttttattacaaggacagccgcgaggagagtgtcctaggcagcgtcctgctccccagctacaatattagaccagatgggccgggagccccccgagggcggcgcttcaccttcaccgcagagcacccgggcatgaggacctacgttttggccgctgacaccttagaagacctgcggggctggctacgggcgctgggccgggcctcccgtgcggagggggacgactatgggcaacccaggtcacctgcacgaccccagcccggggagggccccggcggccccggtggtcccccggaggtgagcagaggggaagaggggcgcatctcagaatcaccggaagtgactcgactctccagaggtcgtggtagacccaggctgctcactcccagccccacaaccgacctccactctggactccagatgcggagggcgaggagccccgacctgttcacccccctctctcgccctccctcgcctctgagcctcccccgtccccgttctgcccctgcgcggcgaccccctgccccctcaggagacacagcaccccctgcccgacctcacaccccgttgagtcgcattgatgtccgacctcctctggattggggcccccaacgccagaccctctcccgaccccctactccccgccgaggacctccctctgaggctgggggaggaaagccccccaggagtccccagcactggagtcaggagcccagaacacagccgggtcctcccctggagtcaactttccaccaaagcttggagacagatacgctgctgaccaagttgtgcgggcaggaccggcttctgcggaggctgcaggaggagatagaccagaagcaggaggagaaggagcaactagaagcagctctggagttgacccggcaacagctgggccaagccaccagggaggctggggctcccgggagggcctggggtcgccagcgcctcttgcaggaccggctggtcagtgtgagggccaccctctgtcacttgactcaggagcgagagagggtttgggacacgtacagtggcctggagcaggagctgggcaccttaagagagacgctggagtacctgctgcaccttggttctccccaggacagagtgtctgctcagcagcagctgtggatggtggaagacacgctggcaggtctgggtggcccccagaaaccgcccccacacactgagcctgactccccatctcccgtgctccagggcgaggagtcctcagagagggagagcctgccagagtccttggaactgagctcccctaggtcccccgagactgactgggggcggcctcctggaggcgacaaagacctcgccagccctcacttaggtcttgggtctccgagggtctcccgggcttccagccctgagggtcgccacctcccttccccacagctaggaaccaagtccaaggaacaccaccccttacttgccgacttccgaaggtcaccgggagcgggttctcagcctctcccaagccctggctactgaggcgtcgcagtggcacagaatgatgacaggtggaaatttggactcccagggagaccctcttcccggtgtgccgctgcctccttcggaccccacgcgccaggagacccctccccccagatctcccccggtggctaattcgggttccacggggttctctcgccgagggagtgggcgtggaggaggtcccaccccctgggggcccgcgtgggatgccgggatcgcccctccggtcctgccacaagacgagggggcatggcctctgcgagtcactctgctacaatccagcttctaatccgcccaaaagcggcagccaatcggagcgcgaggacgtggtctggaggtaccgccggagatctgggaccactcagggcatcagggggcgtggtctggtccccattgcgggcccgggaggggaatggtttctatggccaaagtttggttttctcaacactgtctaaatttggattaaaactttgaactttt

SEQ ID NO: 22712 - DNA, 4804 bp, Homo sapiens
gctcggcgaacatggcggcggcgacggtcgggcgggacactttacctgagcattggtcctacggggtgtgccgggatggccgcgtcttcttcatcaatgaccagctccgctgcacgacctggctgcatccgcgcaccggggagcccgtcaactcgggccacatgatccgctcagacctgccccgcggctgggaggagggcttcacggaggagggcgccagctacttcatcgaccataaccagcagaccacagcattcaggcatcctgtgacgggacagttttctccagaaaatagtgaattcattcttcaagaagagccgaatccacatatgtcgaagcaagacagaaaccaaagaccgtccagcatggtcagtgaaacatccacggctgggaccgcctccaccctggaggccaagcctggacccaagatcataaagtccagcagtaaagtccacagctttgggaagagagaccaggccattcggaggaaccccaatgttcccgtggtggtgaggggctggctgcacaagcaggacagttctgggatgaggctgtggaaaaggaggtggtttgtgcttgctgattactgcttattttactataaagacagccgagaagaagcggtcctcgggagcatccccttgcccagctacgtgatctctcctgtggcccctgaggatcgcataagccgcaaatattcctttaaggctgtgcacacggggatgcgagcgctcatctataacagctccacagcgggctctcaggccgagcagtcaggcatgaggacctactacttcagtgccgacacccaggaggacatgaacgcttgggtcagggccatgaaccaggctgcacaggtgctgtctcgatcgtcactgaagagggatatggagaaggtggagcggcaggctgtcccccaggccaaccacacagagtcctgtcacgaatgtggccgggtgggacccggacatacgagagattgtcctcatcgtggccatgatgacattgtcaacttcgagaggcaggagcaggagggagagcagtaccgttcccagagggacccactggagggcaagcgggaccggagcaaggccaggtctccgtactcgccagccgaggaggatgccttgtttatggatttacccactggcccaagaggccagcaggcacagccccaacgggcagagaagaatggaatgctgcctgcctcatatggcccaggagaacagaatgggactggtgggtaccagcgggcctttcctcccaggaccaaccctgaaaaacacagccaaaggaagagcaatctggcccaggtggagcactgggcaagggcccagaaaggggatagcaggagtcttcccttggaccagacgcttcctcgccagggtcctggccaatccctgtccttcccagaaaactaccagactcttcccaagagcacccgacacccctcggggggctcctcgccacctccccgaaacctgccaagtgactacaagtatgcgcaggaccgagccagccacctgaagatgtcgagtgaagagcgccgggcgcaccgggatggcaccgtgtggcagctctacgagtggcagcagcgccagcagttccggcacggcagccccacagcgcccatctgccttggctccccagagttcaccgaccagggccggagcaggagcatgctagaggtgccccgctccatctctgtgcctccatctccctcggacatccctcccccaggacccccaagggtcttcccaccccggcggccacacacaccagcagagcgagtcacagtgaagccaccggaccagaggaggagtgtggacatctcgctgggggattctccaaggagggcacggggccacgctgtcaagaactcatctcatgtggaccgacgctccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcctgagtgcaaataaagagaacttcagaattctagtggagtcagtaaaaaatccggagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttgaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataa

SEQ ID NO: 22713 - DNA, 4803 bp, Homo sapiens
ccgcgctcggcgaacatggcggcggcgacggtcgggcgggacactttacctgagcattggtcctacggggtgtgccgggatggccgcgtcttcttcatcaatgaccagctccgctgcacgacctggctgcatccgcgcaccggggagcccgtcaactcgggccacatgatccgctcagacctgccccgcggctgggaggagggcttcacggaggagggcgccagctacttcatcgaccataaccagcagaccacagcattcaggcatcctgtgacgggacagttttctccagaaaatagtgaattcattcttcaagaagagccgaatccacatatgtcgaagcaagacagaaaccaaagaccgtccagcatggtcagtgaaacatccacggctgggaccgcctccaccctggaggccaagcctggacccaagatcataaagtccagcagtaaagtccacagctttgggaagagagaccaggccattcggaggaaccccaatgttcccgtggtggtgaggggctggctgcacaagcaggacagttctgggatgaggctgtggaaaaggaggtggtttgtgcttgctgattactgcttattttactataaagacagccgagaagaagcggtcctcgggagcatccccttgcccagctacgtgatctctcctgtggcccctgaggatcgcataagccgcaaatattcctttaaggctgtgcacacggggatgcgagcgctcatctataacagctccacagcgggctctcaggccgagcagtcaggcatgaggacctactacttcagtgccgacacccaggaggacatgaacgcttgggtcagggccatgaaccaggctgcacaggtgctgtctcgatcgtcactgaagagggatatggagaaggtggagcggcaggctgtcccccaggccaaccacacagagtcctgtcacgaatgtggccgggtgggacccggacatacgagagattgtcctcatcgtggccatgatgacattgtcaacttcgagaggcaggagcaggagggagagcagtaccgttcccagagggacccactggagggcaagcgggaccggagcaaggccaggtctccgtactcgccagccgaggaggatgccttgtttatggatttacccactggcccaagaggccagcaggcacagccccaacgggcagagaagaatggaatgctgcctgcctcatatggcccaggagaacagaatgggactggtgggtaccagcgggcctttcctcccaggaccaaccctgaaaaacacagccaaaggaagagcaatctggcccaggtggagcactgggcaagggcccagaaaggggatagcaggagtcttcccttggaccagacgcttcctcgccagggtcctggccaatccctgtccttcccagaaaactaccagactcttcccaagagcacccgacacccctcggggggctcctcgccacctccccgaaacctgccaagtgactacaagtatgcgcaggaccgagccagccacctgaagatgtcgagtgaagagcgccgggcgcaccgggatggcaccgtgtggcagctctacgagtggcagcagcgccagcagttccggcacggcagccccacagcgcccatctgccttggctccccagagttcaccgaccagggccggagcaggagcatgctagaggtgccccgctccatctctgtgcctccatctccctcggacatccctcccccaggacccccaagggtcttcccaccccggcggccacacacaccagcagagcgagtcacagtgaagccaccggaccagaggaggagtgtggacatctcgctgggggattctccaaggagggcacggggccacgctgtcaagaactcatctcatgtggaccgacgctccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcctgagtgcaaataaagagaacttcagaattctagtggagtcagtaaaaaatccggagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgctt

SEQ ID NO: 22714 - DNA, 3688 bp, Homo sapiens
aggatgccttgtttatggatttacccactggcccaagaggccagcaggcacagccccaacgggcagagaagaatggaatgctgcctgcctcatatggcccaggagaacagaatgggactggtgggtaccagcgggcctttcctcccaggaccaaccctgaaaaacacagccaaaggaagagcaatctggcccaggtggagcactgggcaagggcccagaaaggggatagcaggagtcttcccttggaccagacgcttcctcgccagggtcctggccaatccctgtccttcccagaaaactaccagactcttcccaagagcacccgacacccctcggggggctcctcgccacctccccgaaacctgccaagtgactacaagtatgcgcaggaccgagccagccacctgaagatgtcgagtgaagagcgccgggcgcaccgggatggcaccgtgtggcagctctacgagtggcagcagcgccagcagttccggcacggcagccccacagcgcccatctgccttggctccccagagttcaccgaccagggccggagcaggagcatgctagaggtgccccgctccatctctgtgcctccatctccctcggacatccctcccccaggacccccaagggtcttcccaccccggcggccacacacaccagcagagcgagtcacagtgaagccaccggaccagaggaggagtgtggacatctcgctgggggattctccaaggagggcacggggccacgctgtcaagaactcatctcatgtggaccgacgctccatgccctccatgggttacatgacccacaccgtcagcgctcccagtttacatggaaaatcggctgatgatacctacctccagctgaagaaagacctggagtacctggatctaaagatgacaggccgggaccttctcaaggatcgaagtctgaagcctgtgaagatcgctgagagcgacactgacgtcaaactgagcatcttctgtgaacaagacagggtcctccaggacttggaagacaagatacgagcccttaaagagaacaaagaccagctagaatctgtgctggaggtgttgcacagacagatggagcagtaccgagaccagccccagcacttggagaagattgcctaccagcagaagttgctgcaggaggaccttgtccatatccgagctgagctctccagagagtccactgagatggaaaatgcttggaacgaatacctgaagttggagaatgatgtggaacagctgaagcagaccctgcaggagcaacacagaagagccttttttttccaggagaaatcgcagatacagaaagatctatggagaattgaagatgtcactgcaggcctgagtgcaaataaagagaacttcagaattctagtggagtcagtaaaaaatccggagagaaaaacggtgcctttgtttcctcacccgcctgtgccttcactctcaacttctgagagcaagccgcccccacagcccagtcctcccaccagccctgtgcggacccctctggaggttcgactcttcccccagctgcaaacctacgtgccgtaccgacctcacccaccccagctgaggaaagtgacatccccccttcagtcaccaactaaggcgaagcccaaagttcaggaagatgaagcacctcccaggcccccactccccgaactctacagcccagaggaccagcccccggctgtgccgcctctgccaagagaggccaccatcatccggcacacatctgtgcggggcctcaagcggcagtcagacgagaggaagcgagaccgggagctggggcagtgtgtgaatggggattccagggtggagctgcggtcgtatgtcagtgagcctgagctggcgaccctcagcggggacatggcccagccctccctaggacttgtgggccctgagagcaggtaccagacgctgccaggcagagggctctcagggtccacgtcaaggctccagcagtcgtccaccattgctccctacgtcacactccggaggggtctcaatgccgaaagcagcaaggcgaccttccctagacctaagagtgccttggagcgcctgtactcaggggatcaccagcgaggcaagatgagtgcagaggagcagctggagcgcatgaagcgacaccagaaggccctggtccgagagcgcaagaggacactgggccaaggggagaggacgggcctgccctcatctcgctacctcagccggccgctccctggagatcttggctcagtatgttaggaggggccaggcagcggggcagggacagggagccgagtgcccctcagagtcccccaaacacaagcacatcacacctcccagtgagagagctgtccattgacctacatggttcagagaacaccccacggggctgtttgtccacgacccaggctggacgaatgcctggtcagagggtgacctgaaccagagctggagtgaggatcaaacaggcccaggagcctgaggaaatacccagtcagtcctcccagccgcgatggagaggggcctttgcaggcgttcggaatctcggctgaattcaggacctgggaatacagggttcagagaggagaggaggaagatggtgacatgatttggttagaagcacaagcaaactgatcagcctcccagacctgccagcagatgctgtgtgagggtgatggagcacggggtcacacccctgccccaagggccactggtctccctgggcttgcagtgcagaggcctcagggtgtctgggattgctggggaggcctgtgctgccccctggtggcgcttcctggcgctgcgccctgtccacagtcaccttaggtccctttggaaacattccatttgacttttccctgttgtttgaaatcccatgtttccctaaacctctagcctgattgttctttccctaattcattgcacaagctcctttgcttttagtgttaccgctcattgcctctctaatcctgcctgattgtgtttacagaagcttctgatttgcattgaacatgctctaactggcctgtgctacttattaccgggcttgtaatagcggttcttgtctccatagcctgttgagtgttcccagatgtgactcacctttctgctgccctcttcatgcaggcctactgactcataattcacttgtcccaaaagccaccccacaagcctgagccaacctgctgcctgacgccacagtcattggcagaggtctgggcattattaatttataaaaatccatgctttacacctggacagtagacagggacttcagagattgcacgtttgaatacattctcccaagactgaggttgttcggttttaattcctgtagtccaatcacacaatttcttatggaaaaccttttgtgtttctggtatttaataacttgaagggatagcaaaatatactgtgtattcagagggcctctctgcagctgctagctcagacaccaaaggggtaaggcccaggacattcatatctttaaaagctgcaaacctggtaacctttaaacttttaaaacaaatgtcatatggggtaacactgaccttttataatttgatgtctcaaatgtagagattatctaaaaatcgtaacttgaataccttgtaatttttctcttaaaaaagaagacttgtgtaagtctctgcatcaacgccaataaacatgttgcttaataataa

SEQ ID NO: 22715 - DNA, 2016 bp, Homo sapiens
actccccctccctggggtgggcaggtccggagggcggggcccgggggcagctgggctctcaggcgctgcgggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaa

SEQ ID NO: 22716 - DNA, 2380 bp, Homo sapiens
aagagaggaaggcttaaagagccagactgcgcagccaggactggggtgatgggcgctgtcctgccaggccaaagaatgaagatgtagccccgcccccaacctagggaggaggaccagcccggttcctgtcctgcccccgcaacctcgccccgattccactccgggaacctcggcgatgctgagccaagaccacttctgaatcagggatgacttgtctagtgaacctagggtcagagccatcagttggaaaggctgggaggagcctggagaaagagggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaa

SEQ ID NO: 22717 - DNA, 2275 bp, Homo sapiens
aagagaggaaggcttaaagagccagactgcgcagccaggactggggtgatgggcgctgtcctgccaggccaaagaatgaagatgtagccccgcccccaacctagggaggaggaccagcccggttcctgtcctgcccccgcaacctcgccccgattccactccgggaacctcggcgatgctgagccaagaccacttctgaatcagggatgacttgtctagtgaacctagggtcagagccatcagttggaaaggctgggaggagcctggagaaagagggcgaccttccttgggatctgtgcgctccctccttgcctccccctccagcctcccacttggtagcaccttcctgatccccttatctctaaggcgctcagggaaatgccccgctgcgggagccttctgggaaatgctgccctggccacccaggaaccatgagccctgcagccccggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaa

SEQ ID NO: 22718 - DNA, 2061 bp, Homo sapiens
aggcgctgcgggaggagagaaatgccccaggctctccggggcacacaaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggctggggtggaggctgggatcagaccgtggtgggccttcaagctaaggagcttcctaggtgaaaggggagatgtgagccttctctggagggaagtttcatgattgcatctataatgaatatattgcctgttttgtgaatactgacacatgtccatacctaaaacactcctgagtcaagtcccatccttcccacaaacagcttcctggctggtacccatgataacaattgagctgaacctggggacccctggttggggaacaggtgagttctatttgagacttccagccctagaaagctgcctccgtccagaaatgcctctcacaccaggagctcggccctctctttgtagctgtgactgtcaccctctcaggctttgtctcatccttcattctgaataagatggcagtgttctcctctggggcctgatccacctctacaccagcccaggaagccccatctgtgcctgccctcaggtggtccaccagtctccccctttggttcccttccagtctcttccccctttctatcccaatcaccaatagaaatgctaacatccctgcctggtagccagactagcccactaaagctcccctgtaaatgggggctccattagttctgctgccgagactaataaagatttggttggctctagcagtaa

SEQ ID NO: 22719 - DNA, 1049 bp, Homo sapiens
acttctacagatctagaaactgagaccaggacagagggccagggaggagggatatggccaaagttaccaagctgaggctggaatccaggctcctggtccccacccccaccccacaccaatggctgccctgctgaccccacagtgacagtgctcccattctcttcctgagcagagaatggggaggaggccgaggccgcctggcccttgtttactaaccctccctcaaacgtttcctgggtggctccccagggacggcagggctgggggcttctctccagggagctgctgctgaggcctgtgtctcccgtggctcctctgacaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagct

SEQ ID NO: 22720 - DNA, 567 bp, Homo sapiens
aaagcgcaggcgcagcgggttgggtggcagcagcatcgagtagcggccgcttaggcagcaacatccgcaacaagtgtagacaagacattctgatttaattgttacggagtgtggcctggtatcggaagttctcaaagctcctgccggcataacggtttgaagccaggactgctgggtgtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccg

SEQ ID NO: 22721 - DNA, 685 bp, Homo sapiens
ggcaagtgagtcgccctcaggaacagagggcacctacctggattccagtgcaagctacatcatgtacatggatgagtcatttgctaaccctcagtttgtccatctgtaaaacaggagtaaggattcccttcctaacagggttagagtggggacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcgggaggatccctgctacagcgccggcgccc

SEQ ID NO: 22722 - DNA, 1164 bp, Homo sapiens
aaagcgcaggcgcagcgggttgggtggcagcagcatcgagtagcggccgcttaggcagcaacatccgcaacaagtgtagacaaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccgatgataagactgaagctcattcatccgcacaacaaatatttactgagctgctacagcgccggcgcccctctggccatgggcatgcttgcgggagccgccactggggcggcgctgggctcgctcatgtggtcgccctgctggttctgagccctgggactcggagcactgacccctgcgcttggattgctagactcctcttcctcctggaccccatcctctaccatccaagccctgtcccactttggccctatcctctccattagctccttccgggtttggaccattccccccactccctacccttaatccccacatgggaagaagctatcatcacaggtacaaacatcgcttgaagtcttcacatctaccactagacacccccaaaatctgttatagacatttatggatacatttcctctaaacacaacagggcacagcaaatacgacttcatttggcttcgagttccccaggcgctgtagacacaacatgaatcgggctctctgctctctccttagggagctcgagtcctggtggggagaacaggagtaaacaaggacttgacaaagctgaagagttatcagtcctttgacaaggacaggtggggcagggagcaagacaggtaggctggaagaacagttattggcaagtatgcagagccgtgaacgtcatggcatgtccaaggaattaaatgggagttcatttgggct

SEQ ID NO: 22723 - DNA, 618 bp, Homo sapiens
aaacgtttcctgggtggctccccagggacggcagggctgggggcttctctccagggagctgctgctgaggcctgtgtctcccgtggctcctctgacaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggccccagctggagccaccgtccctcccaggagccgccgggtttgctccaaggtcaggtgtgtgacccgctcgtggagcccctgtaaggttgagaggcggatctgggtgcgcgtctacagcccgtaccaagactactacgaggtggtgc

SEQ ID NO: 22724 - DNA, 656 bp, Homo sapiens
aacatccgcaacaagtgtagacaaggtgggtgcatcaaggggaggggctggaaaaggagtctgcacctgaccctcttgtctgatctgtgtcaagaccgtggagaggggagggagcggcaagaggaacagacaaggctgggccttccagcccaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcggccgcctgcacctctgtgcggagaccaaggatgatgccctagcatggaagacagcactgctggaggcaaactccaccccggtgcgcgtctacagcccgtaccaagactactacgaggtggtgccccccaatgcacacgaggccacgtatgtccgcagctactacggaccgccctacgcaggccctggcgtgacgcacgtgatagtgcggga

SEQ ID NO: 22725 - DNA, 534 bp, Homo sapiens
aaagcgcaggcgcagcgggttgggtggcagcagcatcgagtagcggccgcttaggcagcaacatccgcaacaagtgtagacaaggtgggtgcatcaaggggaggggctggaaaaggagtctgcacctgaccctcttgtctgatctgtgtcaagaccgtggagaggggagggagcggcaagaggaacagacaaggctgggccttccagcccaggtgtgccagcccttgttacgcagcaacaggtcccgcctgactccgctctggaaagtccttttgaagaaatggccctggtgaggggcggctggctgtggagacagagctccatcctccgccgctggaagcggaactggtttgccctgtggctggacgggaccctgggatactaccacgatgagacagcgcaggacgaggaggaccgtgtgctcatccacttcaatgtccgtgacataaagatcggcccagagtgccatgatgtgcagcccccagagggccggagccgagatggcctgctgactgtgaacctacgggaaggcgg

SEQ ID NO: 22726 - DNA, 6802 bp, Homo sapiens
tggtcagccacccctggctggctccaggcccagctccccaatattccccactaggcctcagtgtgtcctcatttctatctgtacctttgccatcctgggccatgcaacctgtagctctcggcctcttctgtctcctttcaggctgagtctctgaatctgtctccatttgtgactctggtttccatgggatacatagatgtggagcctcaggagggcaggggtagtgtgatcagtgtcaggcgccccaaagcatttattctgtgccaggccctgtgctggatgctgaaagtacggaagtggataacatacagtctctgtttccatgaagcctacaatgcacattctctgtggagtggagaaaccagggcccagccctgcctctatctcagtatggctgtacctcccctgaatctgcctgctgtgcccagggtgccaggtcagctatagcctgtggcttgaggctcttctttgcctctggcattcacaggggtatgtgtgcccgccagcaggtcccccccggctcttagggctcctgggggacttggctggtgggtgctggtgggcagcagaaggggagggagggagcagaaggcagtgactcagtgggggtggccctgggacagaactggggaggaagccaaggttggatgatgcttcctgaagccaggagggtgggaagagaggtctggctgggagttagggatggagcaggacaactccaaggctcccctctggcagccagacctgctcatgaagaaggctcctcggtagctgcctgaaagtctggactctgggggctgggctgggctgggtggggagattgctgttggtcccactgtgcctgttgtaatccccaggttcatgaaagaggtgcctgccttagagccagggaagccgttgcacccggtgccccctctccccagggaccatgggcctgggcacactgtggggctcagggtcttctcctggtcgcagagctgaccttcccacaatcttcccacaaattctggggagtgtcgggccaggcccacatgccctaaagggacctcaaatcgcacagctacccacttgggtagctttcatcagttcaggattccctgactgcgggtgaaatgagggggcagggcaccaacacagcccgagtgctggcagcgggtgaacgtataacacagggagtcttccccagtcctcacggcaaccccaggagaaaaatgactttccatttttacaggtgaggagggtgaggctcaaagagcagagttcctggagcgcccccagcaggtaagtggagaagccaggcctgggctgggggctctggctccagaaccccacctcagcaccagcctcctgcaccggactttgtggagaagggggtaagggggtgccagggatggcaaaggggtagaggatctggtggactctggcaggcctgggtcagctccacccattggtctcactcccacccggatggcagccccatcccacgtgggatcatgcgacctgtctctgggtgcccgcggcgaggcagcaccccgcttccctacacagaaggccttcccctcccgtcggctcattcagccgcggaagcccctgggagaccccgccccgccccgtcccgcggtgccccccgcgcactcaccctcgctcacccacgcggccttcctggcgggagagcgcttccggcgtcctcgccaggcccggggagtgggcacggtggagctgccgaccgttggtcgctgccccaacccacgcactgcgacgccgcgggtgaggcgcgcggtctgcggggcccgggggtgcggcggggcggggctggcgggctgtccgggcccacggagaggacggcggcgggcgggggttgctgcagggcccgcaccttgtcttccgcgccggcagggctgtgccccgtcgagacctgctcgggctgtggctccgtcctccggcctccagggggcggcgcggcgctgcgcggcgccccggcggcactgccctcccttcccagcggccaggaggcggtgtcccgtgacgccgcgcggccgcgctgtagtggccgtcgaggccgccgtctgttcgaaggctgtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgc

SEQ ID NO: 22727 - DNA, 4477 bp, Homo sapiens
gctgtccgacttcacggttccccgcggctcggcccgggggcgcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgc

SEQ ID NO: 22728 - DNA, 2182 bp, Homo sapiens
gccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcaggtaaggaaggctgggctagggaagtctgggaagggaatggggatgcctggagagatgagtgtcaagactttggaggtctctgaccctactcaggctgaagcccgggtccaagtaggggtctctggataggtggtccaaggcagacccaagtcatttcccttcccaagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcttattgccctcaatcacaggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagct

SEQ ID NO: 22729 - DNA, 4566 bp, Homo sapiens
accctcgctcacccacgcggccttcctggcgggagagcgcttccggcgtcctcgccaggcccggggagtgggcacggtggagctgccgaccgttggtcgctgccccaacccacgcactgcgacgccgcgggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacagggtgagagtgacaccccaggggtagggttggtaggggacccaggtccaagcagggcgatgccatctggcttgagccctggggcattggacagcgaccctgtgggccttggagaccctttatcagaaatatcaaagctgctggaggcagcccccagtggatccggcctccctaagcctgctgactgcctcctggcccaagacctctgttgggagctgctggccagtggtatggccaccttgccagggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgc

SEQ ID NO: 22730 - DNA, 4480 bp, Homo sapiens
gtccgacttcacggttccccgcggctcggcccgggggcgtgagtgtcgccagcgggcgacgggggggcgcgcggtaggccctgcaacaaggccagggcctgggggggccggcaggagagcgaacccgaggcatcgtggtgccatggcggggccgcccccacgggcatgggcctgcagagcgtggccgtgaggacgctgagggtgggcgcgcacggagcagaggcccacgggcgtccgacgggggacctggacagagggacacccttaacgttattccctcttcccaggcctgaattgcagttcctgtgccctggcactaagactggcacctcctgcggcccatgcccttcgcctgcattgcccactgagtcccactcgactgtcttcagcgcggttcacactgagacccagccctctcccgctggccccgagcaggcccacctttaggagggcgtgatggaaaggcccctggagaatggggatgagtccccagactctcagggccatgccaccgactggagatttgctgtgtgcagtttcagggatgcctgggaagaggaggaacctgcttcccagatgcacgttaaggacccaggtcctccaagaccaccagccggggccacccaggatgaggagctacagggcagccccttgtccaggaaattccagttacccccagctgcagatgagtcgggggatgcccagaggggcacagtagaaagctcctcagtcctgtcagaagggccaggcccctctggagtggagagtctcctatgccccatgtcctcccacctcagcttggcacaggggactcgggatgtccaaggccgggcagtgctgcttctgtgtgcccacagcccagcctggcttcagtctgagtgcagcagccaggaactcatccgcctcctgctgtacctgcgaagcatccccaggcccgaagtacaggcactgggactgacagtgctagttgatgcccgaatttgtgctccaagttcttccctcttctctgggctcagccaactacaagaagcagccccaggggccgtgtaccaggtgctgctagtgggaagcacgctgctgaaggaagtgccttccgggctgcagctggagcagttgccttctcagagcctgctgacccacatcccaacggcggggctgcccacttcgctaggaggaggcctgccttactgccaccaggcctggctggatttccgaaggcggctggaagctctactacagaactgccaggcagcttgtgccctgctccagggggccatcgaaagtgtgaaggctgtgccccagcccatggagcctggggaggtcggtcagctgctacagcagacagaggtcctgatgcagcaggtgctagactcgccatggctggcatggctacaatgccaggggggccgggagctgacatggctgaagcaagaggtcccagaggtgaccctgagcccagactacaggacggcaatggacaaggctgacgagctatatgaccgggtggatggattgctgcaccaactgaccctgcagagcaaccagcgaatacaggccctagagttggtccaaacactggaggcccgggaaagcggactgcaccagattgaagtgtggctgcagcaggtgggctggccagcactggaggaggctggggagccctcgctggacatgctgctccaggcccaaggctcttttcaggagctgtaccaggttgcccaggagcaggtcaggcaaggggagaagtttctgcagccgctgactggctgggaggcggctgaactggacccccctggggcacgctttctggccctgcgagcccagctgactgaattctctagggctttggcccagcggtgccagcggctggcggatgctgagaggctgtttcagctcttcagggaggccttgacgtgggctgaggaggggcagcgagtgttggcagagctggagcaggaacgcccgggggttgtgttgcagcagctgcagctgcactggaccaggcaccctgacttgcctcctgcccacttccgaaagatgtgggctctggccacggggctgggctcagaggccatccgccaggagtgccgctgggcctgggcgcggtgccaggacacctggctggccctggaccaaaagcttgaggcttcactgaagctaccaccggtgggcagcacagctagcctgtgtgtcagccaggtccccgctgcacctgcccaccctcccctgaggaaggcctacagcttcgatcggaatctggggcagagtctcagtgaacctgcctgccactgccaccatgcggccactattgctgcctgccgcagaccagaggctggaggaggtgccctgccccaggcatcccctactgtgcctccaccaggcagctctgaccccaggagcctcaacaggctacagctggtgctggcagagatggtggccacggagcgggagtatgtccgggctctagagtacactatggagaactatttccccgagctggatcgccccgatgtgccccagggcctccgcggtcagcgtgcccacctctttggcaacctggagaagctgcgggacttccactgccacttcttcctgcgtgagctggaggcttgcacccggcacccaccacgagtggcctatgccttcctgcgccatagggtgcagtttgggatgtacgcgctctacagcaagaataagcctcgctccgatgccctgatgtcaagctatgggcacaccttcttcaaggacaagcagcaagcactgggggaccacctggacctggcctcctacctgctaaagcccatccagcgcatgggcaagtacgcactgctgctgcaggagctggcacgggcctgcgggggccccacgcaggagctcagtgcgctgcgggaggcccagagccttgtgcacttccagctgcggcacggaaacgacctgctggccatggacgccatccagggctgtgatgttaacctcaaggaacaggggcagctggtgcgacaggatgagtttgtggtgcgcactgggcgccacaagtccgtgcgccgcatcttcctttttgaggagctgctgctcttcagcaagcctcgccatgggcccacaggggttgacacatttgcctacaagcgctccttcaagatggcagaccttggtctcactgagtgctgtgggaacagcaacctgcgcttcgagatctggttccgccgccgcaaggccagggacacctttgtgctgcaggcctccagcctggctatcaagcaggcctggacagctgacatctcccacctgctttggaggcaggccgtccacaacaaggaggtgcgcatggctgagatggtgtccatgggtgtggggaacaaggccttccgagacattgctcccagcgaggaagccatcaacgaccgcaccgtcaactatgtcctgaagtgccgagaagttcgctctcgggcgtccattgccgtagccccgtttgaccatgacagcctctacctgggggcctcgaactcccttcctggagaccctgcctcttgctctgttctggggtccctcaacctgcacctgtacagagacccagctcttctgggtctccgctgtcccctgtatcccagcttcccagaggaagcagcactggaggctgaggcagagctgggcggccagccctctttgactgctgaggactcagagatctcgtcccaatgcccatcagccagtggctccagtggctctgacagcagctgtgtgtcagggcaggccctgggtaggggcctggaggacttaccctgtgtctgagcccgggactggacgagcagtagatccagcagcctgcagctccaaggaacattgcctctctggatctgctgtgaccagggtgtggctgacacctgggctacctccaacctacatgtgcaacgctgttgactaccctttctgatgtgtgtggccattggactaactggcacggggcctctctagggaagtctggttgtagagcctgaataggctcctggccccatgaccccttctcctgtccccagctcccatcccagttgtgggttaagaataggctagagcagacattgggtgtttccatgctgtaggctggtgggggaccatgtgcctctaggcagtgactagggtgcccccacccctcaggaagaacacaggtgggctcctagcagctgatccccaatgcctggccttaaagccgagctcagttaccatagggacaggtccacctctactgggccctcatgcttgcctttcctggcccccaggcccagcccctttttactggggcagtttcgttattttgacttgatgccttttgaataactttcaatagaattgtctaaaattatcttactggttgttaggcctttggtgtctcagagaaggagtctaggtctttgatgtgtgatttaatcttttatttgtttataataaaaaatagactgatatgtaccctctgatgggcacatgc

SEQ ID NO: 22731 - DNA, 4715 bp, Homo sapiens
agtttgcgctgagtcgactgagcccgtcccgcggctcccgtccccctctccccgcgcgccccatgaggctttggcagtctcggcccgagccttagagccttagacaccggggaggagaccctggtcctgttcctaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 22732 - DNA, 3475 bp, Homo sapiens
gagtcgactgagcccgtcccgcggctcccgtccccctctccccgcgcgccccatgaggctttggcagtctcggcccgagccttagagccttagacaccggggaggagaccctggtcctgttcctaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 22733 - DNA, 3613 bp, Homo sapiens
agatgaagaccagggagaggaaagggtggacctgaggcccccatggagaagggacgggcaggatgtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 22734 - DNA, 3753 bp, Homo sapiens
ggacgctgacctcttttgaagggaggactgaggagatcaccccacccctcctccggttgggaggccagtggggcccaggggagcctgggtgccccgctgactgatgccctctgctcctcccctgcagacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 22735 - DNA, 4190 bp, Homo sapiens
aaactaaggccttcctggtagccaaggagcccagcagaggggctgctgctggctgctgggattgcagaggccggggtctctgtggtgttgctttcctggaaaggagggacggcacctccagggcagccagcagtgtgggagcccattccagggcgcaaatgggcactcaggaatggaaaatccaagaaggaaccaaccaccaacaaggaaatgcagtgtgagcggcggctgcgaagtctgtgccttcaaatatacagcgcccaggggacctgtgttggacggggagcaaattggcagggctgagagcgccttggttttctgtgcagacaggtccagctgcagaaattaagactggggctgagtcggggagaagccttccatgttgagatggcaactgggcaaagcaggacggagacctgtgtgtctgattagagaggcctgtggcattggcatgtggctggaggtccaggcagggtgccaccaccgcagaggtcaagcatgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcc

SEQ ID NO: 22736 - DNA, 3550 bp, Homo sapiens
cttgatctcccgctgtgaccagcccctctctgcctggcaggggaaagccaccaaactaaggccttcctggtagccaaggagcccagcagaggggctgctgctggctgctgggattgcagaggccggggtctctgtggtgttgctttcctggaaaggagggacggcacctccagggcagccagcagtgtgggagcccattccagggcgcaaatgggcactcaggaatggaaaatccaagaaggaaccaaccaccaacaaggaaatgcagtgtgagcggcggctgcgaagtctgtgccttcaaatatacagcgcccaggggacctgtgttggacggggagcaaattggcagggctgagagcgccttggttttctgtgcagacaggtccagctgcagaaattaagactggggctgagtcggggagaagccttccatgttgagatggcaactgggcaaagcaggacggagacctgtgtgtctgattagagaggcctgtggcattggcatgtggctggaggtccaggcagggtgccaccaccgcagaggtcaagcatgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 22737 - DNA, 5221 bp, Homo sapiens
aaactaaggccttcctggtagccaaggagcccagcagaggggctgctgctggctgctgggattgcagaggccggggtctctgtggtgttgctttcctggaaaggagggacggcacctccagggcagccagcagtgtgggagcccattccagggcgcaaatgggcactcaggaatggaaaatccaagaaggaaccaaccaccaacaaggaaatgcagtgtgagcggcggctgcgaagtctgtgccttcaaatatacagcgcccaggggacctgtgttggacggggagcaaattggcagggctgagagcgccttggttttctgtgcagacaggtccagctgcagaaattaagactggggctgagtcggggagaagccttccatgttgagatggcaactgggcaaagcaggacggagacctgtgtgtctgattagagaggcctgtggcattggcatgtggctggaggtccaggcagggtgccaccaccgcagaggtcaagcatgaattcagtcctgacaaaacatgggtctccacctcgaagctggctcagcctttgttcaggaaccgacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 22738 - DNA, 4698 bp, Homo sapiens
agcattcaaggagctccccaggagaaagagcaagttctgaggagccctctgagcccggcattggtgttgaggagggagtcagagaagagaggggcccggggccgcgcagaggcgcagaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactccactgggaagagtcctttgctttggggcccagtgactcggggcacttgagttcagggcggcctccttgtgttcctgtgctcctccacttgccacggatgggccacggatggagcttgccatgggaagcactgggaagtaatggggtgtggggtgccaccagaccaacacccccagacttccccaccttcagccaccatcagagcctctccccaggtgccccccggggattcagggctgaatctgcccagttcccacactcaggccagccctcttgggaaggtgggtcctccatgggggtcccttcaggaactttttttttttttttaatacagagtctcactctgtcacctaggttggagtgcagtggtgtgatgtcggctcactgcaacctctgcctcccgggttcaaacgattctcctgccccagccactctagtagctggaactgcaggtgtgcaccaccacgccgggctagtttttgtattttaagtagagacggcatttcaccatattggtcaggctggtctcgaactcctgaccccaagtgttccgcccgcctctgcctcccatagtgctagaattacaggcctgagctactgcgcttggccccttgcggtacttttggcccaacctcctccatggctggggacgcggaggccgagagagaagtcacttgccctggctctaccttgaagtggttctcagggttggggcgagagtcggggtggggaccgagatgcagctctatcctgtgcccctggtcgcagcaggcagcccagcgcttcgcgtgttctacttggcctgtccgctgccgcctaatgagctcaggtctaggccgagcagagggggcacctggtcggactcggttgggctcgggcggccccgcctccccccgcccgccaggcgggcccttctcgacggcgcggggcgggccctgcgggcgcggggctgaaggcggaaccacgacgggcagagagcacggagccgggaagcccctgggcgcccgtcggagggctatggagcagcggccgc

SEQ ID NO: 22739 - DNA, 3697 bp, Homo sapiens
cccagtccccggcgtccccggcgcccccgcccgccgcccgccccccgcgcggcacggggcctgctccatggacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcca

SEQ ID NO: 22740 - DNA, 3694 bp, Homo sapiens
gcagaccgcggcttcctccggccgccatggggacaggacccggtgtctccggacgcctagcagcctccaggccgggcccggggctgcccctccgggactcggagccctcctgggccgggggtcgtgcccgcgacggtgatagccaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagactcc

SEQ ID NO: 22741 - DNA, 3456 bp, Homo sapiens
agcattcaaggagctccccaggagaaagagcaagttctgaggagccctctgagcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcctggggcgtgccggcacctgcttcagctactgcctcctgtatgcatgagccggatgctgggcaggatccctgcctacgcccgggcccgatttgcgctttgccggactggatggagtggaggaggcccaggccacagtaccaccccacctgcccaggcagcccctcgtcacctactccccgaagttaccagctcagctcgagtcttcagggctgggctcctaggctgcccatcctacttctaccctcactggcctccagtgggattcactcctgccctgcccccaccttcccagtcccacaggccacccctggcttgggctgggttctgtgaagttacgtatttattgagcttttggttcttttataaagacttgtctagac

SEQ ID NO: 22742 - DNA, 3381 bp, Homo sapiens
accgcggtgcactccagcccccaggaagagaggcagcttggagggggccaaattcagggtcaaagatgagtcttggggaacgggggtcgccccagaccttcgggggctcctctgtctctaaagggagcgatgcagggcacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccaggtattaggactcagggctcccctcaggaagctgggcccagctgggattgccgaggggcccctagccctggcagcggtcctgggctagtcggctgcctggccggggaacctgcaggctcccacaggaagaggtgtggagacctgccctcgggggcctctcccagggtccagcctgagcccccaccaggggtctctgcccagcacaggaagctgaccctggcccagctctaccgaatcaggaccaccctgctgcttaactccacgctcactgcctcggaggtctgagcagagggaggcccccaagagtgccattgaccaagagacagcagacagcctgcctcct

SEQ ID NO: 22743 - DNA, 3062 bp, Homo sapiens
gtgcgagggtccggcggcggcggctctgcggcctcccagtccccggcgtccccggcgcccccgcccgccgcccgccccccgcgcggcacggggcctgctccatggacgaccagagccccgctgaaaagaagggactgcgctgtcagaaccccgcctgcatggacaaggggcgggcggccaaggtatgtcaccacgccgactgccagcagctgcaccgccgggggcccctcaacctctgcgaggcctgtgacagcaagttccacagcaccatgcattatgatgggcatgtccgcttcgaccttcccccacaaggctctgtgctggcccggaacgtgtccacccggtcatgcccgccgcgcaccagccccgcagtggacttggaggaggaggaggaggagagctctgtggatggcaaaggggaccggaagagcacaggcctgaaactctccaagaagaaagcaaggaggagacacacggatgacccaagcaaggaatgcttcactctgaaatttgacctgaatgtggacattgagacagagatcgtcccagccatgaagaagaagtcactgggggaggtgctgctgcctgtatttgaaaggaagggcattgcgctgggcaaagtggacatctacctggaccagtccaacacacccctgtccctcaccttcgaggcctacaggttcgggggacactaccttcgtgtcaaagccccagccaagcctggagatgagggcaaggtggagcagggcatgaaggactccaagtccctgagtttgccgattctgcggccagctgggaccgggccccccgccctggagcgtgtggacgcccagagccgccgggagagcctggacatcttggcccctggccgccgccgcaagaacatgtcggagttcctgggggaggcgagcatccccgggcaggagccccccacgccctccagctgctctctgcccagcggcagcagtggcagcaccaacactggcgacagctggaagaaccgggcggccagtcgcttcagcggctttttcagctccggccccagcaccagcgcctttggccgggaggtagacaagatggagcagctggagggcaagctgcacacctacagcctcttcgggctgcccaggctgccccgggggctgcgcttcgaccatgactcctgggaggaggagtacgatgaagacgaggatgaggacaatgcctgcctgaggctggaggacagctggcgggagctcattgatgggcatgagaagctgacccggcggcagtgccaccagcaggaggcggtgtgggagctgctgcacacggaggcctcctacatcaggaaactgcgggtgatcatcaacctgttcctgtgctgcctcctgaacctgcaagagtcagggctgctgtgtgaggtggaggcggagcgcctgttcagcaacatcccggagatcgcgcagctgcaccgcaggctgtgggctagcgtgatggcgccggtgctggagaaggcgcggcgcacgcgagcgctgctacagcccggggacttcctcaaaggcttcaagatgttcggctcgctcttcaagccctacatccgctactgcatggaggaggagggctgcatggagtacatgcgcggcctgctgcgcgacaacgacctcttccgggcctacatcacgtgggcggagaagcacccacagtgccagaggctgaagctgagcgacatgctggccaaaccccaccagcggctcaccaagtacccgctgctgctcaagtcggtgctgaggaagaccgaggagccgcgcgccaaggaggccgtcgtcgccatgatcggctccgtggagcgcttcatccaccacgtgaacgcgtgcatgcggcagcggcaggagcggcagcggctggcggccgtggtgagccgcatcgacgcctacgaggtggtggaaagcagcagcgacgaagtggacaagctcctgaaggaatttctgcacctggacttgacagcgcccatccctggcgcctccccggaggagacgcggcagctgctgctggaggggagcctgaggatgaaggaggggaaggacagcaagatggatgtgtactgcttcctcttcacggatctgctgttggtgaccaaagcagtgaagaaggcagagaggaccagggtcatcaggccacccctgctcgtggacaagattgtgtgccgggagctacgggaccctgggtccttcctccttatctacctgaatgagtttcacagtgctgtaggggcctacacgttccaggccagtggccaggccttgtgccgtggctgggtggacaccatttacaatgcccagaaccagctgcaacagctgcgtgcacaggagcccccaggcagtcagcagcccctgcagagcctggaagaggaggaggatgagcaggaggaggaagaggaggaggaggaggaggaggaggaaggcgaggacagtggcacttcagctgccagctcccctaccatcatgcggaaaagcagcggcagccccgactctcagcactgtgcctcagatggctccacggagaccctggccatggttgtggtagagcctggggacacgctgtcctcccccgagttcgacagcggtcctttcagctcccagtctgatgagacctctctcagcaccactgcctcatctgccacgcccaccagtgagctgctgcccctgggtccggtggacggccgctcctgctccatggactctgcctacggcaccctctccccaacctccttacaagactttgtggccccaggcccaatggcagagctagtgcctcgggccccagagtccccacgagttccttcccctccaccctcgccccgtctccgccgccgcacccctgtccagctgttgagctgcccgccccacctgctcaagtctaagtccgaggccagcctcctccagctgctggcaggggctggcacccatgggacaccctctgcccccagccgcagcctgtcagagctctgcctggctgttccagccccagcacaggaagctgaccctggcccagctctaccgaatcaggaccaccctgctgcttaa

SEQ ID NO: 22744 - DNA, 2881 bp, Homo sapiens
agcgcctcgcgggggtctggcccggagtggagggcgcgcggtcccagccctcccgctcggccggcgggtgtcgagttcagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctcctcaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaatt

SEQ ID NO: 22745 - DNA, 1424 bp, Homo sapiens
aaaagaatgtaggaaggaaggaaggaacgaatgaacatgggagcgcagaggggaggaggagagaggctggggtggattcagtttcagactggacaatctgatgtgccccagagagggaggcagagcctccaccatccatcagaagacagaaaaagcctttggccagctactgtgccagccactgggagagcccaagatacagcatcccctgaaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctcctcaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaatta

SEQ ID NO: 22746 - DNA, 2963 bp, Homo sapiens
ctggcctcccgaaggcgggaggaggggagccgggggctgggctgagacaggaccctgggtagggagcagtgcgagggagacagcgccctcagagggaggactattgggaggcggcaggagggacagcgaacgtttcctcctctgctcctgaatcggaggaagccctaggggacctctttctcctggacattgaagatatggccctttggaggtgacccaggagagaagggatgaaggcctttggtcctccacatgagggccccctccaaggactcgtggcctcccgcattgagacttatgggggccggcatcgagcctctgctcagagcactgctggcagactctatccccgaggataccctgtgctggatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctcctcaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttacaaaaaaaaattttaaaaatt

SEQ ID NO: 22747 - DNA, 3111 bp, Homo sapiens
atcaaaccccagagctggcgcctcccaggctcccgcctctgcttggcaggagtttgaggccttcctgagatctgcctctccctgagtcaggatgaagatgagcaaaggttcagggtgtccctactcctccagtggtgggtagggacaggagggtgcctgccttggctccacccctggctccacctgcctggctctcctccagtcctaaccaagcagaggggtgtggaagccaggtctgtccctcagcctgcaggtttcccctccaccttgaggacagttctgcttgtggctgggacatcccctgcctcaatgcacgataattttgcctttggagatgggactttcctaggctgtgggtgagaagggagactagaaagtatgtggggtaattcaggccacaggcaaatgaaggaatgtgaccaggcctgccctgggaggagctgtgtggctgtggcttcagcctttcacacagaagggcagccactcccagctggatgggatgcaggctgcacgcccctggggagaaggctgcacatgatcccagtcgccgacgcctccagcagtatgtcccctttgccaggggttctggccaggcccgaggcctgtcacccatgagactgcgagatccagagcccgagaagaggcacgggggccatgtgggggctggcctgcttcactcccccaaactcaaggaactcaccaaggcccatgagctggaggtgaggctgcacactttcagcatgtttgggatgccccggctgccccctgaggaccggcggcactgggagataggagagggtggcgacagtggcctgaccatcgagaagtcctggagggagctggtgcctgggcacaaggagatgagccaggagctctgccaccaacaggaggccctgtgggagctcctgaccaccgagctgatctacgtgagaaagctcaagatcatgactgatctgctagccgccggcctgctgaacctgcagcgagtgggactgctgatggaagtgtcagctgagaccctgtttggaaatgtccccagcctgattcgaacccaccggagcttttgggatgaggtgctggggcccaccctggaggagactcgggcctcgggccagcctctggaccccattggtctgcaaagtggcttcctgacgtttggccagcggttccacccctatgtccagtactgcctccgagtgaagcagaccatggcttacgcccgagaacagcaagaaactaaccctctcttccatgccttcgtgcagtggtgtgagaagcacaagcgctctgggaggcagatgctctgtgacttgcttatcaagccccaccagcgcatcaccaagtacccactgctgctccatgctgtgctcaagaggagccccgaggcacgagcccaagaggccctgaatgccatgattgaagccgtggagtcattcctgcgacacatcaatgggcaggtccgccagggcgaagagcaagagagcttggcggctgcagcacaacgcatcgggccctacgaggtgctggagccacccagtgatgaggtggagaagaacctgcgcccattctccaccctggacctgacgtcccccatgctgggggttgcatctgagcacaccagacagctgctgctggaggggcctgtgcgagtgaaggagggacgagaagggaagctggacgtgtacctgttcctcttctctgatgtgctccttgtgaccaagccccagcgcaaggcggacaaagccaaggtcatccgaccccctctcatgctggagaagctcgtgtgccaacccctgcgagaccccaacagcttcctgctgatccacctcactgaattccagtgtgtctccagcgccctccttgtgcactgtcccagtcctacagaccgtgcccagtggctggagaagacccagcaggcccaggccgccctacagaagctgaaggcagaggagtatgttcaacagaagagggagctcctgaccctctatcgggaccaggacagggagtcccccagcaccaggccctccacgccttccctggagggctctcagagcagcgcagaggggaggactcctgagttctcgaccattatcccccacctggtggtgacagaagacacagatgaagatgctccccttgtgccagatgatacctcagactctggctacggcactttgatcccaggcacccccacggggtcccgctccccactgagccgtctacgccaaagagcccttcggcgggaccctcgcctcaccttctccaccctggaactccgggacatccctctgcgtccccaccctcccgacccccaagctcctcaacgccgaagcgcccccgaactgccggaaggaatcctaaaaggaggcagtcttccccaggaagacccaccaacctggtctgaggaagaagatggggcctccgagcgagggaatgtggtggtggaaacactccacagggcccggcttcggggccagcttccctcctccccaacccatgctgactctgccggggaaagcccctgggagtcctcaggggaggaggaagaagaggggcctctgttcctgaaagctggccacacatccctgcgcccaatgcgggctgaggacatgctcagagagatccgggaggagctggccagccaaaggattgagggggccgaggagccccgggacagcaggccacggaagctgactcgggcccagctgcagaggatgcgggggccccacatcattcagctggacacccctctgtccgcatcagaggtatgaggaatgcagaggacctttggcatgcatctctcccagaggagatctctccccagtagtgctggtcaccctccggcatctgtgactctacctcaaggaccacatttcccaaaggaagcctggcccaggcaccctgcctcctgctctgtttggggatcaagaactgtaaatttatgtatcataggtgcacctgagccccacagaaagttgtgcataaaaatgactgccctggctgggcatggctgcctgtaatcccagcactttgggaggctgaggtgggaggatcccttgagcccaggagttccagaccagcctgggcaatatagggaaaccctgtctttac

SEQ ID NO: 22748 - DNA, 6981 bp, Homo sapiens
gagctcggcttgaggcgggcgcgggctgagagtccggggatcccgggggccagtcgcggccgggacatcgggcgctgcggccggggacccgctgctgagatagacagaatatggcagagctttctgagccagagggaccagtagattggaaggaacgatgtgtagctctggagtcccaactcatgaaatttagagttcaagcaagcaagatacgagagcttttagcagagaagatgcaacagcttgagagacaagttattgatgctgaacgtcaagcagaaaaagcttttcaacaggtacaagttatggaagataaattaaaagcagctaatattcaaaccagtgaatcagagacaagattatataataagtgtcaagatctggagtcgctaatacaggaaaaagatgacgtcattcaaaacttggaattgcaacttgaagagcagaaacaaataagaatacaagaagctaaaataatagaagagaaagcagctaagataaaagaatgggtaacagttaagttaaatgagctggaattggagaatcagaatcttcgtttgatcaaccaaaaccaaactgaagagataagaacaatgcagtcaaaactacaagaagttcaaggaaagaagtcatccactgtctctacactaaagctttcggaaggccagcgcctgagcagtttgacctttgggtgctttttatctcgagcaaggagtcctcctcaagtagtaaaatctgaggaaatgagcaagatatcatcgaaagaacctgagttcactgaaggaaaagacatggaagaaatggaaattccagaaaagtctgttgataaccaagttctagaaaacaacagaggccagagaacattgcatcaaaccccttgtggctcagaacagaatcggaaaacaagaacaagctttgccacagatggtggcatctcccagaattctggggctcctgtgagtgactggagctctgatgaggaagacgggagcaaaggaagatccaagtccagatgcacatccaccctctccagtcacacatctgaggaaggggtccagtgtagcaggatgggaagtgaaatgtatctgacagcatctgatgacagcagctctatatttgaggaagagacttttggcataaagagaccagaacacaagaagctatattcttggcagcaggaggcacagtggaaagctctaaatagtcctcttggaaagggaaattctgaattaagtaaaaaggaacaagatagttcctcggatgaactgaataaaaaatttcaatcccagagactcgattattcatcttcatcgagtgaagccaacaccccaagccctattttgaccccagctttaatgccaaagcatcctaactcactctctggaaaaggaacacaattagtgccttcatcacacctgccacccccaaagttaaggattcctaatgttttcagtataagtgtagcactagccaaaaggcacttaagccagccacagttaagctctgacaggatgtttggtacaaatagaaacgctataagcatgatacgaccactgagacctcaggaaactgatcttgatctagttgatggagacagtacagaagttttagagaatatggacacgagttgtgatgatggattattttcctatgactccttggactctccaaattcagatgaccaggaacactgtgactcagcaaagaaggtggcatacagcaaacctccaactcctcccctgcaccgttttccttcttgggaaagcagaatttatgctgtagccaaatcaggtattcgaatgtctgaggccttcaatatggagagtgttaataaaaattctgctgcaaccctttcctatactacatcaggactttatacatctctgatatacaagaacatgaccaccccagtgtatacaactttgaaggggaaggcgacccaaataagtagcagccctttcctggatgactcatctgggtcagaggaagaagacagctccagatccagctcccggacgtcagagtcagactcacgcagtaggagtgggccaggcagccccagagccatgaaacgaggtgtgtctctctcctctgtggcttctgaaagtgattatgctattcctcctgatgcttactccacagacacggagtactcacagccagagcagaagctcccaaaaacttgctcatcttccagtgataatgggaaaaatgaaccactggaaaaatctggttatttattaaaaatgagtggtaaagtcaagtcttggaagcggcggtggtttgttcttaaaggtggtgaattactttactacaaatctccgagtgatgtaattagaaaaccccagggccatattgaacttagtgcatcctgtagtattttaagaggagataacaaacaaacagttcagttgaccactgaaaaacacacatactatctgactgcagattctcccaatatattggaagagtggattaaagtgttacagaatgttcttcgagtacaagctgccaacccactttccctgcagcctgagggcaaacccaccatgaagggattgctcactaaggtaaaacatggatattccaagagagtctggtgtacactaataggaaagacattatattattttcggagtcaagaagataagtttcctttaggtcagatcaaactctgggaggctaaagtggaagaggttgacagatcttgtgattcagatgaagattatgaagccagtggacgaagtctgttatccacacattatactatcgttatccatcccaaagaccaaggtccaacttacctcctaattggatccaagcatgaaaaggacacttggctttatcatctgactgttgcagctggaagcaacaatgtaaacgttggatctgaatttgaacaactggtttgcaaattgctaaatatagacggggagccttcctctcagatatggagacaccccactttgtgtcacagtaaagaaggaatcatttcccctctgacaactctaccttccgaagccctgcagacagaagctattaaattatttaagacctgccagctttttataaatgctgcagttgactctcctgcaattgattaccacatatctttagcccagagtgctttgcaaatctgcctgacacatcctgagctgcagaatgaaatttgctgtcagcttattaaacagacaagacgaagacagccacagaatcaaccaggaccattgcagggctggcagctcttggcactctgcgttgggctcttccttccccatcatcctttcctgtggctcctcaggcttcacctaaagaggaatgcagattccaggacagaatttggaaaatatgccatttactgccagcgttgtgtagaaagaacgcaacaaaatggtgacagagaagcaagaccctcaaggatggaaattctttcaactcttctccgaaacccttatcaccattctttgccctttagtatacctgtgcacttcatgaatgggatataccaggtagttggttttgacgcatctaccacagtggaagaatttttgaatactttgaaccaggacacaggaatgaggaaaccagcgcagtctggatttgcgttgttcactgacgatccttctggcagagatttagagcattgtcttcaaggaaacatcaagatttgtgacattatttccaaatgggaacaggcttccaaagaacagcagcctggaaaatgtgaaggtacaaggactgttcgtctgacatacaaaaacagactatatttctcagtgcaagctcgtggagagactgatagagaaaagttgctgttaatgtatcagacaaatgatcaaatcataaatggactttttcctctgaacaaagatctggcattagaaatggcagctcttttatctcaggtagagattggagattttgaaagacctttctcaactccagcagggcatgttaccaatcagtgcaaagtgaatcaaactctaaagcaagtcatagagaaattttatcctaaaaggtatagagatggctgttctgaagagcagttaaggcagctttgccagcgactttcaaccagatggatggccctccggggacacagtgctgctgactgtgtgcgcatttatttgacagtagccaggaagtggccattctttggtgccaagttgtttcttgcaaaacccataactccatcatcacttggaagtactttcttgtggctggctgtacatgaggatggtttaagcctcttagaatacaactccatgaggttaatagtcagctatgtgtacaagagtctaatgacctttggaggctatcaagatgattttatggtagtcattaacaatacacattcaaaggacaaaccaacagagaaattactttttgccatggcaaaacccaagattcttgaaatcactcttttgatcgccagttacataaacaacttccatcagcaaaaggcagcatttcaccacctctctgctccagcactgctctcagcccagacccggggaccccaagccagaatgatgggaagccagcctcttctgtcaagcagcagaccgaccaaaggccccaccttactctgaaagctggggagcctgaacattcactccttgtcctccatgctgtggctgtatcagctccctacaagttcgtttacacctggcagcacggcagccacacaccggtattccaaaccttaacaatgaagggggttagtctcttttatttgattcttaaatattcaaataaatattaacagtaaaacataaacacaaaatttgccaacacactaattttcttatagagtaaatgagtaagaattcatcattttttccatctcccttctcccttgtcatcagacacattgtgcaatgtggcttttcttttcttttctttttttcccctttttaatattctggcaatctttagaaagggagattccaaactcccatttggtaaaccagttgattatttggaaatgttcactgccaaaatagtaagtgctataactaaatgcgcttttaattaatgatatagtgtttggaaaggagtagaacatgcagcataagaaactgctgcagagtggtgcgaggagtacattttcagagcaggtgcagtacatcttccggctctatgaatcattatgtgagaaagcaggataacattaggtaacctgagcctcctgtgtggtattagaaagtataccgtcaccttttcacatcactggagtgtaaaatttaaaacaagatggtgattcctgacattccttggctgtcagtgctgcccagattcagaagaatattgcccacatttcactgtatttggtgctgggtcattttgaccttgctttgttaataatatctttaaaaacaaagacaatccttaaagctttgctcctcacacattaccttctaattatagtttgaaaatagattccctacacatacatacatatgtatgcacagatagggtcttgctatgttgcccaggctggtcttgaactcctggcctcaagcaatcctctctcctcagcctcccaaagtgctgggattacaagtgtgagccaccacacctggctccagaaattttattttatttttttgaggcagggtctcactctggttgcccaggctggagtgcagtggtgccatcatagctcactgtagcctcgaccttccgggatcaagcaatcccacttcagcctcttgaatagctgggactagaagcatgcaccaccatgcccatctaatatttgtatttttagtagagacaggatctccctatgttgtccagcctagtctcaaactcctgggttcaagcaatcctcccacctcggcctcccaaagtgctgggattgcaggcatgagccaccgtgcccagcctcaaaaatattttttaaaagaaaagagaaaataattcttctgtcaaaggaggttaaattttagttgatagagtacttaaatgcattactttattaggttatgtaagtggtcagtgcattccagtatgtgtcacaacagtgtagttcatattcatgataaaaatgaaactgtgataagacatgaaaattatattattaaaatgttcaattgtaatggtaatcatgagtatacttaattttatttatgtatagaatatttgtatttattttttggacatatatttatcactttgtcattttttttaaccaatttgagaaatgttagctgctgaattaatttgttgcccgagccttcatattttcttctttgctgccttctccctgtggcaatgtactgttctcacattaagccttttaaaaatgttccatactgtattagcatccttagaagggacagaactaagaaatacattgctcaaataatattttactttattgataatgacaaaaagaatattttttaaaccccatcaaaatagatttcaattgactgtttcccctacatcttttgagccacagtcgcccatcgaataagcaaatttgtttttgagaataaactggtaaccagtttgtgatgactctcagaagccttttggctgggttacagaagagtttctaagttcctagagagccatttaataattagttggtgagccagaggcttgacagagctgttacttatgtgtgagggctttattctcaggcagtagtttattcatcatttggtaagcccctccccacactcctctaatttaaacaagtagtgaaggcttatcttaaactgtgtagtaccttagacttggcatttatttttgatagagcagagataaaatattttgatggaaggaaatcaattttctgtaactgatgatgtgaaaattttattttctgggaaattatatagccattcaaaaattcaaagtatgttattatgattggttacaagagaataatgttacatgtttaattgtaatatttgtctcctatcattttcttccctttcagtcataataaatgatttacaaaaccca

SEQ ID NO: 22749 - DNA, 4995 bp, Homo sapiens
agaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctc

SEQ ID NO: 22750 - DNA, 5298 bp, Homo sapiens
aacgtgatggcgtcaggggccggggcgccgcttcctgttgtcagtggccgagagaccgcatcgtcggctcggaggctgaggggctgccgcggccgggagcgcccctcgcctcgctcctcgctccgcttggtgtcatgtgattctctgagggagcagctgcgtgagtggagatgctttcagtggtggagaatggactggacccccaggctgccatcccggtcatcaagaagaagctggtgggatccgtgaaggccttgcagaagcagtacgtgtccctggacacggtggtcactagtgaagacggagatgccaacaccatgtgcagcgccctggaggccgtatttatccatggcctgcacgccaagcacatccgagctgaggccggaggaaaaaggaagaaaagtgcccaccagaagcctctgccccagcctgtcttctggcccctcctgaaagctgtcacccacaaacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattcctcaaggccctgattgaatttgcctcccagcatgtctaccactgcgacctgtgcacccagcgcggcttcatctgccagatctgccagcaccacgacatcatcttcccctttgagtttgacaccacagtcaggtgtgccgagtgcaagaccgtcttccaccagagctgccaggctgtggtgaagaagggctgcccccgctgtgcccgccggcgcaagtaccaggaacagaacattttcgcctgatgcccatctgctgaccccgctctgaaagccgggggtgagtgtggctcagccatcccggctgggtttgccatcagcccaggatactcaccgtgtcacagctgtgtccccttgtcaggaagaccctcagatgtggccagagcaccggcctcccagagaaagcccaggaagtccccgtggtgtcccctggccctccccccacccctctgctgcaggaggcgtggccaccaccagatgctccctgtctggggcaggcagggccgtttactcaccaggccctggctcaccagcgtcccggcgcctccgttagggctgcccaaacactgtggaaaggggacttggggagcattttcaattccacattcctgattaaaaggtctagttttttaaggtgggtttttcccattcatatttcaacagaaagtatttttttattcttgaccctacgtgagtcacccatgaaatccagacattctcacccccagcggatgcacaggagccactcaggcctggcttagaggtagcgggtggctggtgggcaggccactgctgggacagggtctatgggcccacccagtgcctttccttggccctcactgccagtgccaaaccgcccctcagcagggcagggccagtcctggcgaccccggttcctctgtgtcctctttactccccaccccagtgcgtctcgcctgctgagcccaccgctttctcagcgtcagagcccctagctcttctctagcctggggccttggccccattaggagaaggagaaatgactggaaaccagcactgtcagcactttgagccctcctcggtttatggagggtcgccgtcttgcccacccccgatccccgtgcgctcctcacccctctacagacaggggcgctgctgcagatgctccaggcccaccttggtgggtgcccggggtcacactctctgcctgactgacccctgccagggcacagataggcaggaccccagagagggcaggcagccacgccctgcactgtggagaagtgacctggtcctaagctgtgcagggcgtgcgggggaactgccctgtggatgcagccaccacctcacaaagccatgaattcccaaagcatcactgaacttgcccagccgggacactggagactgaagaagttccccggagcaggactgcctttgaaggggccttggggctggggtgggagtctggaattgttttcaaagtgatggtcagaccctccaggcttcggggaaatgtgggtttgctggtctctctgtcgccttcccccacctctcctggacctagcaggccctcagtcctagctgtcttacctgcgctcagcttggagtcaggcctcaggtggagagccgcatgtcactgtcagagatgagcccacccccacccttccctgggggcgattagctgctgagtcacccacccagccttggagctggatgcctgtgcagcagaacagaggcaacggtggcaggcaggtggaggctgcgcacagcttctcccggtcatggcacacacctgtgcccagacgccaatgcctcctaagccaggagctgggttatgcaccgccatggcccacattaacgctccaccacaagcccagcctagtcagagccctcattgccccatccctgagtgggcaggagcctggcctggggagggcttgggcctgtgaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctcatc

SEQ ID NO: 22751 - DNA, 3118 bp, Homo sapiens
acacaattcaggcagtggagagaaggccgtggggagtggctgaggagtccctcaagagaagaggttgctgttcactgatggtggagtgttttgagagtggtggaaccaggttatccctttcttcttttaacgtgtcatgtgattctctgagggagcagctgcgtgagtggagatgctttcagtggtggagaatggactggacccccaggctgccatcccgacacatcatctcagagttggagcacctgacgtttgtcaacacggatgtgggccgctgccgggcatggctgcggctggccctgaacgatggcctgatggagtgctacctgaagctgctgctgcaggagcaggcccgcttgcatgagtactaccagcccaccgccctgctccgggatgctgaggagggcgagttcctccttagcttcctgcagggcctcacgtccttgtccttcgaactctcctacaagtctgccatcttaaatgagtggacgctcaccccattggccctgtctgggctttgcccgctttctgagctggaccctctctctacctctggtgcagaactacagcggaaggaatctctggattccatttcccattcttcaggctctgaagacatcgaagtccatcactcgggccataagatacggaggaaccagaagctgactgcctcctccctcagcctggacacggccagttcatcccagctgtcctgcagcctaaactctgatagctgcttactccaagagaatggctccaagagtccagaccattgcgaggagcccatgtcctgtgactcagacctgggcacagcaaatgctgaggactcagaccggtctctgcaagaggtattgttggaattcagcaaagcccaggtaaactctgtgccaaccaacggactgagccaagaaacagagatccccacaccacaggcctcgctctccctccatggcctcaacaccagcacatacctgcactgtgaggcacctgcagagccccttcctgcccaggcagcctctggaactcaagatggtgtccacgtgcaggagccgcgtccccaggcgcccagccccctggacttacagcagcctgtagagagcacctcaggccagcagccttctagtactgtcagcgagacagccagagaagtgggccaagggaatggcctgcagaaggcccaggctcatgacggagctggtctgaagctggtagtttcctcacccaccagtccgaaaaacaagagctggatctcagaggatgacttctaccggccttcccgggagcaacccctggagagtgcttcagaccacccaatagcttcttacagggggactccagggtcaaggcctggtctccacaggcatttttctcaagaaccaagaaaaaactgctccctgggggcgttagaccaagcgtgtgtaccttccccaggaagaaggcaagcccaggcagccccatcccaggggcataagagcttccgggtggtacaccggagacagatgggactgtccaacccattccggggtctcatgaagctgggcaccgtggagcggcggggggcaatgggcatctggaaggagctcttctgcgagctctccccgctggagttccgcctctacctgagcaacgaggagcacacctgtgtggagaactgctcgctgcttcgctgtgagtctgtggggccagcccatagtgatgggcgctttgagctggtcttctctggcaagaagctggccctgcgcgcctcctcccaggacgaagctgaggactggctggaccgggtgcgggaggccctgcagaaggtccggcctcagcaggaggatgagtgggtgaacgtgcagtacccagaccagcctgaggaaccccccgaggcgccccagggctgcctctctccctcagacctgctctcggagcccgcggccctccagggcacacagtttgactggtcgtccgcccaggttccagagccagatgccatcaaggagtccctgctgtacttgtacatggacaggacctggatgccctatatattttctctgtccttggaggctctgaaatgtttccgcatcaggaacaatgagaagatgctgagtgacagccacggcgtggagaccatccgggacatcctgccagacaccagccttgggggcccatccttcttcaaaatcatcacggccaaggctgtcctgaagctgcaggccggaaacgccgaggaagccgccctgtggagggatctggtccgcaaagtcctggcatcctacttggagacagccgaggaggcggtgaccctgggcgggagcctggatgaaaactgtcaggaggtgctgaaatttgccacccgggagaatggcttcctgctgcagtacctggtggctatccccatggagaaaggccttgactcccaaggctgcttctgcgcaggctgctcccggcagatcggcttctcctttgtacgacccaagctctgtgccttctctggcctctattactgtgacatctgccaccaagacgatgcctcagtgattccggccaggatcatccacaactgggacctcaccaagcgcccgatctgcaggcaggccctgaagtttctgacacagatccgggcccagcccctcatcaacctgcagatggtgaacgcgtctctgtacgagcatgtggagcggatgcacctcattgggaggagacgggagcagctgaagctcctgggggattacctgggcctgtgccggagtggcgccctgaaggagctcagcaagaggctcaaccacaggaattatctcttggaatctccgcataggttcagtgttgctgacctccaacagatcgcagacggggtgtatgaaggattctccccgaaggtgccctcggaggcagcaggtttgaggccctggggggcccgttccccagaagctgccagtgctttcagatgcattgactcttcccgcctcccctccctcagaaaggtagtgcccacactatttttaaaatgttattttatgcaatacactgttcctagtgagcagggctctggccctgaggagtctttgcaatgtattgaaggaattgctgccgtgtgagttttgaatgattttgcagtaaagacctgatctttctc

SEQ ID NO: 22752 - DNA, 5781 bp, Homo sapiens
gttgtttcctcctcctcctcctccgcctccgccgccgttgcttgaatggtggagccgaagctcggctcgtgaacacacactgacagctatagggcaggcggcggcaccgtccccgcttcccctcggcggcggggtgtcccgtcggcggccctgaagtgacccataaacatgtcttgtgagaggaaaggcctctcggagctgcgatcggagctctacttcctcatcgcccggttcctggaagatggaccctgtcagcaggcggctcaggtgctgatccgcgaggtggccgagaaggagctgctgccccggcgcaccgactggaccgggaaggagcatcccaggacctaccagaatctggtgaagtattacagacacttagcacctgatcacttgctgcaaatatgtcatcgactaggacctcttcttgaacaagaaattcctcaaagtgttcctggagtacaaactttattaggagctggaagacagtctttactacgcacaaataaaagctgcaagcatgttgtgtggaaaggatctgctctggctgcgttgcactgtggaagaccacctgagtcaccagttaactatggtagcccacccagcattgcggatactctgttttcaaggaagctgaatgggaaatacagacttgagcgacttgttccaactgcagtgtatcagcacatgaaaatgcataaacgaattcttggacacttgtcatctgtgtactgtgtaacttttgatcgaactggcagacggatatttactggttctgatgactgtcttgtgaaaatatgggcaacagatgatgggaggttgttagctaccttaagaggacatgctgctgaaatatcagacatggctgtaaactatgagaataccatgatagcagctggaagttgtgataaaatgatccgagtctggtgtcttcgaacctgtgcacctttggctgttcttcagggccatagtgcatctattacatcactacagttctcaccattgtgcagtggctcaaagagatatctatcttctactggggcagatggcactatttgtttttggctctgggatgctggaacccttaaaataaacccaagacctgcaaaatttacagagcgccctcggcctggagttcaaatgatctgttcttcttttagtgctggtggaatgtttctggcgacgggaagcacagatcatattattcgggtttatttttttggatcaggtcagccagagaaaatatcagaattggagtttcatactgacaaagttgacagtatccagttttccaacactagtaacaggtttgtaagtggcagtcgtgatgggacagcacgtatttggcaatttaaacgaagagagtggaagagcattttgttggatatggctactcgtccagcaggccaaaaccttcaaggaatagaagataaaatcacaaaaatgaaggttactatggtagcttgggatcgacatgacaatacagttataactgcagttaataacatgactctgaaagtttggaattcttacactggtcaactaattcatgtcctgatgggtcatgaagatgaggtatttgttcttgaaccacacccgttcgatcctagagttctcttttctgctggtcatgatggaaacgtgatagtgtgggatctggcaagaggagtcaaaatacgatcttatttcaatatgattgaaggccaaggacatggcgcagtatttgactgcaaatgctctcctgatggtcagcattttgcatgcacagactctcatggacatcttttaatttttggctttgggtccagtagcaaatatgacaagatagcagatcagatgttctttcatagtgattatcggccacttattcgtgatgccaacaattttgtattagatgaacagactcagcaagcacctcatcttatgcctcccccttttttggttgatgttgatggtaaccctcatccatcaagatatcaaagattagttcctggccgtgaaaattgcagggaggagcaactcatccctcagatgggagtaacttcctcaggactgaatcaagttttaagtcagcaagcaaaccaggagatcagcccactggacagcatgattcaaagactacaacaggagcaagacctgagacgttctggtgaagcagttatcagtaataccagccgtttaagtagaggctccataagttctacctcagaggttcattcaccaccaaacgtaggactaagacgtagtggacaaattgaaggtgtacggcaaatgcacagcaacgcaccaagaagtgaaatagccacagagcgggatctggtagcttggagtcgaagggtggtagtacccgagctatcagctggtgtagccagtaggcaagaagaatggagaactgcaaagggagaagaagaaataaagacttacaggtcagaagagaaaagaaaacacttaactgttccaaaagagaataaaatacccactgtctcaaagaatcatgctcatgagcatttcctggatcttggagaatccaaaaagcaacagacaaatcaacacaattatcgtacaagatctgcattggaagagactcctagaccctcagaagagatagaaaatggcagtagttcttcagatgaaggcgaagtagttgctgtcagtggtggaacatccgaagaagaagagagagcatggcacagtgatggcagttctagtgactactccagtgattactctgactggacagcagatgcaggaattaatctgcagccaccaaagaaagttcctaagaataaaaccaagaaagcagaaagcagttcagatgaagaagaagaatctgaaaaacagaagcaaaaacagattaaaaaggaaaagaaaaaagtaaatgaagaaaaagatggaccaatatcaccaaagaaaaagaagcccaaagaaagaaaacaaaagagattggctgtgggagaactaactgaaaatggtttgacattagaagaatggttgccatcaacatggattacagataccattccccgaagatgtccatttgtgccacagatgggtgatgaggtttattatttccgacaaggacatgaagcctatgtcgaaatggcccggaaaaataaaatatatagtatcaatcccaaaaaacaaccatggcataaaatggagctacgggaacaagaacttatgaaaatagttggcataaagtatgaagtgggattacctaccctttgctgccttaaacttgcttttctagatcctgatactggtaaactgactggcggatcatttaccatgaaataccatgatatgcctgacgttatagatttcctagtcttgagacaacaatttgatgatgcaaaatacaggcgatggaatataggtgaccgcttcaggtctgtcatagatgatgcctggtggtttggaacaatcgaaagccaggaacctcttcaacttgagtaccctgatagtctgtttcaatgctacaatgtttgctgggacaatggagatacagaaaagatgagtccttgggatatggagcttatacctaataatgctgtatttcctgaagaactaggtaccagtgttcctttaactgatggtgagtgcagatcactaatctataaacctcttgatggagaatggggtaccaatcccagggatgaagaatgtgaaagaattgtggcaggaataaaccagttgatgacactagatattgcctcagcatttgtggcccccgtggatctgcaagcctatcccatgtattgcacagtagtggcatatccaacggatctaagtacaattaaacaaagactggaaaacaggttttacaggcgggtttcttccctaatgtgggaagttcgatatatagagcataatacacgaacatttaatgagcctggaagccctattgtgaaatctgctaaattcgtgactgatcttcttctacattttataaaggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaataccaatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgcaaaaaaaaaaaaaaaaaaaaaaacaa

SEQ ID NO: 22753 - DNA, 1896 bp, Homo sapiens
tatatagagcataatacacgaacatttaatgagcctggaagccctattgtgaaatctgctaaattcgtgactgatcttcttctacattttataaaggatcagacttgttataacataattccactttataattcaatgaagaagaaagttttgtctgattctgaggatgaagagaaagatgctgatgtgccaggaacttctactcgaaaaaggaaggaccatcagcctagaagaagattacgtaatagagcccagtcttacgatattcaagcatggaagaaacagtgtgaagaattgttaaatctcatatttcaatgtgaagattcagagcctttccgtcagccggtagatctccttgaatatccagactacagagacatcattgacactccaatggattttgctaccgttagagaaactttagaggctgggaattatgagtcaccaatggagttatgtaaagatgtcagacttattttcagtaattccaaagcatatacaccaagcaaaagatcaaggatttacagcatgagtttgcgcctgtctgctttctttgaagaacacattagttcagttttatcagattataaatctgctcttcgttttcataaaagaaataccataaccaaaaggaggaagaaaagaaacagaagcagctctgtttccagtagtgctgcatcaagccctgaaaggaaaaaaaggatcttaaaaccccagctaaaatcagaaagctctacctctgcattctctacacctacacgatcaataccgccaagacacaatgctgctcagataaacggtaaaacagaatctagttctgtggttcgaaccagaagcaaccgagtggttgtagatccagttgtcactgagcaaccatctacttcttcagctgcaaagacttttattacaaaagctaatgcatctgcaataccagggaaaacaatactagagaattctgtgaaacattccaaagctttgaatactctttccagtcctggtcaatccagttttagtcatggcactaggaataattctgcaaaagaaaacatggaaaaggaaaagccagtcaaacgtaaaatgaagtcatctgtactcccaaaggcgtccactctttcaaagtcatcagctgtcattgagcaaggagattgtaagaacaacgctcttgtaccaggaaccattcaagtaaatggccatggaggacagccatcaaaacttgtgaagaggggacctggaaggaaacctaaagtagaagttaatatagtggtgaaattatacacaagaaaaggggtagaaagcccaaaaagctacagtatgcaaagccagaagatttagagcaaaataatgtgcatcccatcagagatgaagtacttccttcttcaacatgcaattttctttctgaaactaataatgtaaaggaagatttgttacagaaaaagaatcgtggaggtaggaagcccaaaaggaagatgaagacacaaaaattagatgcagatctcctagtccctgcaagtgtcaaagtgttaaggagaagtaaccgaaaaaagatagatgatcctatagatgaggaagaagagtttgaagaactcaaaggctctgaaccccacatgagaactagaaatcaaggtcgaaggacagctttctataatgaggatgactctgaagaggagcaaaggcagctgttgttcgaagacacctctttaacttttggaacttctagtagaggacgagtccgaaagttgactgaaaaagcaaaagctaatttaattggttggtaacttgtaccaaaatattttacttcaaaatctataaagcaggtacagttaaggaataagtagaactaaggcttctgcttccttgctgctgtggtggagtagggaatgttatgatttgatttgc

SEQ ID NO: 22754 - DNA, 8069 bp, Homo sapiens
tttttttttttaagttattttctgtaatgcattttctgtgaatttattgtcttaaaaattggcaaatatggccattttgacatatttgccaaatatgagcatatggcaactatgctcttaatttgttaagtcaccaactgttggtggtaactgttgaaataacaagagcaaagttatcaccaatctacgggatccttacactactgatattttcaataatgcaccgtagtcagacattgtagacttaacctctgagctgctcacaaaattactaaatcattctgaaatacgtaactgcaaattctgggctttaaagtctctagttaaatgggtgattttgaaaattggtggctgttcagacattttcaaatgagaatagaatgcatttgtttcagactgataaactgcagaaggttagataacaccaaacacatttgagtttctcctaagaaaatgacttgggcctccagattacatctcattttttttttttttaccctatcaagtttgtttttccatatgaaatgtctttcccaactacacctgcccttggagactgtgaataacagacttaaaggaagtatcctttccagatgagctgaagaatgtcatcctcttaaaagaatgaacagctggtcatgtagaaattctctggaatgctcacttgtcctacaaaggcaggggagcagaaaacatgtagtttttttgttattggtatacataattgtaaatcttcgagataattttactagaagtccacataattttaataattgcctttctcctgaaaagattgctaataaattaacaatgtgaaggctagaaagctggccaagcataatccggtgggactcaggattgctggctggattgtcccgtttgatcagacattgtttcttagatgaatattcaggacgccctcgtgtataaaagttgtcctttgttctgactaccttggtattaagttcgaatttcttaccatgacacacaaaggattcgattcttgcttagctctctaagctcctctcactttctcttcccctcttgaattctttgctcttgccacacaactagcagatgaactaatctatctgttccaacgtgggcacagtagcagccgtaactcttaccttggcccactctgacttgtccagccctggttgaattcttcgtatccccgtgagggtccgcacgtagttggggctgtttactaaacggatgaacttccctaccgggaggctaggtctcggttatgccttacttcccaggaagcggcttctataggcattgtttaaatgtaggagtaggagggagctgggggtattgcattccccaggtcacagataaatgagattccaaaaccaagatctggctaggccttggaaagagggacctgcgaggccgaccagacgtttggaactgcgccttgcagtgtgggatctcagcaccggatattaccccggtttgtagagagttgagttactgttttaagagacgttgcaaaccgtacgggtcaagaagaaagccgaagacgggttagcgcctgcggtcggggtcgagaaaagcaggcgagatgcgacctgacgtgggtccgcctctctccacccgtggcaagcccgacagtcgcactattgctttaacaatcgccctctttccaagaagagctacttagtgaccgtgagcgaatatgcgtgggaagacacgatgtcctctcggcctctgtgcgctcagttgtttacctaggcgtccgggggaggcacactcgcgggactcgcgggactcggccccggcctcccagctcgcccaggacacgacgctggttctgcgggctctcggagcccagcgcgaatcccccgggctaattcccaagaaccgagaggcagcactgcctggaggctgcccccgcctccgcgcccccgtcctcactttctgaggctgttagcagagagtcccgcgggccggggagaagcgggacgcgggggatggcctcgcagcgccctgtgagcgtcggcagtagtcaggcagccagggctccttgggcgatcgccctgggtagaggagaggagtttccggggctcgggtccgggtcgccttccaggggaacgagcgcggaagcaagtgggcggcgagaggcggagcaagagacgctggagggcgtggacgcagcgggctttggaaaggccccaagttaatgaggcgtgcgccggctgccgagcgcctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagcccccctcgcagccgcagccgcagccgcagctccagccccaaccccagcctcagcctcagccgcaaccccagccccaatcacaaccccagcctcagccccaacccaagcctcagccccagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagtttttttttaaatgcttgttctaagacatttctgaatgtagaccattttccaaaaaggaaactttattttcaaaaacctaatccgtagtaattcctaatcttggagaataaaaaagggcggtggaggggaaaacattaagaatttattcattatttctcgagtactttcagaaagtctgacactttcattgttgtgccagctggttgaaattaaaactctgatattactttttttgaggatttttatttttgtttttgcttaaacatatagtttgtctagaagtttaaaaagctaaaagttaaaaatggtgtaattatgaaaatctaacactcaagatagtttctaaaaggaaatcagtagttaaggatacctgatttcaaaatatttaaagcataacctaactgatggtaggatgattgtatcttgaatatgtggtagggccacatctattgtaggaaaaccttgcttttatcatctgtgtgtaaagggcttaataaggagaagaggccttttgactgatttgtgagtataaatgcatttgctgtttcatttcaaaaatgttgtggaggaaaagagtacatttaacttgtataagagaatatttgtactcctgtccaggctgcaggacctttcttcgagagctttgcacacttgacttgaaccacattttctgatccctttactttgttttagaagcacactgaaaaatctcgttgtttaaagtacaatttgtaaatatttcaaaggtctaggagtcataacttttgttttcatactgaaaatgatgttgatcagagaaaccaactgttttgcttttcattgctctgtgagaaatttgaggattctgttttgctgttaggtaagctaaactcagaaattgaaaaggaaaagactggataaacacaggattttcagtaagaaaacaaccccagtcttgtcttagaagccacttgttgaggagtctgttgggggaaaaaagaggatatgcttttaaaggtagaacaaaccttcttctgtgttaaatcaaaaggatgttcaaaatccaccaggacagatgctacttgggtttaaatggagccatagatgatacaaagtcctcttggggctgaaaatcacttcctatttgcatggctttactaactggtttctgttttccattatctttttcacagaaagtcttggtcagtatttttccagcatttaaattgaaacggtcagtattagaccactgctaggttatgtagtcaagaaataaaaatagaattacatgctacagatgtctttattctccttccatctagaaaggagttccaaggtcaaattactttttagtgcaatagttaaatgacattttgagatcataactcatatccaaaaagttgcagggaaaattaaaatagctttcccctattaagctaatggcaaacaaaacttaagtggacccccacttccagtggttgtttaggttgcagttgtgaaaatatgctgccaacatttaaaaacttgtttcatatgtatatatgtatacacatatatgaatatgtatgtatatatacatatatgagaacatgtgtgtacacatatatgaatatgtatatatgtgtatgtatgtatatatgtatatgaaatgagagccacatctaaagatttcttaaatcaagtttggttcagcttccttagaactgtggctgtactttttgaggagtacctcatagtactatatttttaatgcatgcaaatcataatagctccaaatgaaccacagttttttcccaatggaggatttttttttaattcttgtactaaaaaaaaaaaatccataccaaatatttttacaaattaagattgatgtaggttttaaaaaaggcatttgtatgttgttagcttacatatggggctaggtaatttcattgcttaaaaagatgcgcctaggctccctcttggtggctggatttctttttcttcgcccgtggtggccatggttcttaatagggccaccggaatcatggtttctttttttttttttttttttgagatggagtctcgccctgtgacccaggctggagtgcagtggcacgatctcggctcactgcaacctctgcctcctgggttcacgccattctcctgtctcagcctcctgagtagctgggactacaggtgaatgccaccacgcccggctgatttttgtatttttagtagagatggggtttcaccatagtggtcaggctgttctcgaactcctgacctcaggtgatccacctgccttggcctcccaaagtgctaggattacaggtgtgagccaccacacccggccccagaataatggtttcttgactttctgtagcccttgttccttagtctgctgtgatatttatgttgacctttatcattttctattctgaacccctcttagcatttaatgtgaaatctaagaaattagaagtagaatggcttttattgttttgacacctttgaaattattattaataatttttccagagcaaaaaagcaaacacgctcaataagactaaacaaaacaaaatataaatgtacatcatttaatgtcccagtggctctattctacctgtaagaaaatgatacaaaaccacctaagatattttgaagcctgacaaatcagcttcatggaaaaaggtaaaaaatgcatttttcaaccgaaagggcagatccaatagaagacccgctccttaaataaacataaaatgtaaaaagttggaaaattaagagtaatgttccatctggaaactgaacttttgtccttgaacttgtgttggcaccaagcctcatacacagtgagctcaataactgttgggacaaaggaaggaaggacaaaatgtgtaacttcccagcatctgggagatgctgtctcttgcctcactgagtgttccttttctttgctctcatgtcattccctgagaacaatgaattctgggacaggctaaacatcatgatgaagtttcttaaacagactttcttagtggaaatccatttagatctgggtgtgctctatggggagtgctgacgtcaaagagcaaatgtctataaggggcccttttaaaatgaacattttcctcattgagcaagctgggattctctaatgtagaaatcaagccatctttataatttcacttcagatgtttatgtttttgttttttttgtctccaatgatggtaaaaataaaaactacgcattacttaaaggagtttccctcacatgtaaacactgttaggaagtctggattaagttgaaagtcctgttttaactttttttctctcatataccaaacactctgtatttctcttaaagaagccctttaagagaaagccctaattttatatctgacagtaaagtttgctgcaagtgtatgagttcaaacacatcccttgttttctgtccctaggggaaaagtcatgtagttttagcttggctccagtgttaatattatattcagtagcagccttagaagagtggtctaagacttgaacctggagcaattttatagcacagaatcctacgaagataggactgtgaacatttgttttctttttcgtgtgtgtcaaactaactggtttttgctttaccaataaaatgtcctcggcagagtaaattttaaacgtgaaaattatagatcttgatattgaatccatcagtgattcaagagatacacctatttgcctaaaacaacctaagatgtattggttatggaatcatgtgttggataggttcttaagacctgtttcctcaaatcttgacacagttttcaagggtggcttattgacttgcacggttgggcagataatccagatttacctaagattgggtaaaaaagtcatctgtgactttgctggcagggcatttgctaagtggagtacaggatctaaaagggttttcttagaaagggcaatattgtccaatgaagtaagcagaaggactctgggttagaagcatctgcacaaaaactggtgagacctactctccactgctctgcagctggatggctgatggcaggctgagcagtggggaagcaggttttaacaacagggagtccttccaggtcactgtatattgagaagaaacataaaactattgtctgttacattccgaggtcagccttcttcttaacgttttataatatgcaaatgccagcttctggaaagcaagtatcatcatgtaccaaatgctttatacaccatcacattcatgaattttttagcatggtcagaacttgtgtaaatatgtctcttagatgattttggggagatgtgatttatttttcatattttcaaaatgcatttcatttcaaataaagttatctattgagacaaccga

SEQ ID NO: 22755 - DNA, 1522 bp, Homo sapiens
ctcttggagctgggctttcccccgcggtgcgggcgccaggagccgccttttccgctgggtgtcactcgggggtggggaagatggcccattcaaaagcgccgcgagggggcccggccagtgcccttcagtgagcgctcgcaagaggacggcagaggcccggcagctcggagctccgggaccttgtggcgcatcaggacgcggctgtccctctgccgggacccagagccgccgccgccgctctgcctcctgcgtgttagcctcctctgcgcgctccgggcaggcggccgtgggagccgctggggcgaggacggcgcgaggctgctgctgctgcccccggcccgcgcggctggaaacggagaggccgagccaagcggcggcccctcttatgctgggaggatgctggagagtagcggctgcaaagcgctgaaggagggcgtgctggagaagcgcagcgacgggttgttgcagctctggaagaaaaagtgttgcatcctcaccgaggaagggctgctgcttatcccgcccaagcagctgcaacaccagcagcagcagcagcaacagcagcagcagcagcagcaacaacagcccgggcaggggccggccgagccgtcccaacccagtggccccgctgtcgccagcctcgagccgccggtcaagctcaaggaactgcacttctccaacatgaagaccgtggactgtgtggagcgcaagggcaagtacatgtacttcactgtggtgatggcagagggcaaggagatcgactttcggtgcccgcaagaccagggctggaacgccgagatcacgctgcagatggtgcagtacaagaatcgtcaggccatcctggcggtcaaatccacgcggcagaagcagcagcacctggtccagcagcagctccacccgtatccgcatccacatccacatccacactctcatcctcactcgcacccacaccctcacccgcacccgcatccgcaccaaataccgcacccacacccacagccgcactcgcagccgcacgggcaccggcttctccgcagcacctccaactctgcctgaaaggggcagctcccgggcaagacaaggttttgaggacttgaggaagtgggacgagcacatttctattgtcttcacttggatcaaaagcaaaacagtctctccgccccgcaccagatcaagtagtttggacatcaccctactgaaaacttgcgattcttcttagttttctgcatacttttcatcacgatgcaggaaacgatttcgagtcaagaagacttttatttatgaacctttgaaaggatcgtcttgtatggtgaattttctaggagcgatgatgtactgtaattttattttaatgtattttgatttatgattatttattagtttttttttaaatgcttgttctaagacatttctgaatgtagaccattttccaaaaaggaaactttattttcaaaaacctaatccgtagtaattcctaatcttggagaataaaaaagggcggtggaggggaaaacattaagaa

SEQ ID NO: 22756 - DNA, 955 bp, Homo sapiens
gcagctataaaggccgcgccggggccacgaggagcagagccggcgccgtcaccgcccgcattgccgctcccagtcccgcgctcggcacgacatgaaatcccccgacgaggtgctacgcgagggcgagttggagaagcgcagcgacagcctcttccagctatggaagaagaagcgcggggtgctcacctccgaccgcctgagcctgttccccgccagcccccgcgcgcgccccaaggagctgcgcttccactccatcctcaaggtggactgcgtggagcgcacgggcaagtacgtgtacttcaccatcgtcaccaccgaccacaaggagatcgacttccgctgcgcgggcgagagctgctggaacgcggccatcgcgctggcgctcatcgatttccagaaccgccgcgccctgcaggactttcgcagccgccaggaacgcaccgcacccgccgcacccgccgaggacgccgtggctgccgcggccgccgcaccctccgagccctcggagccctccaggccatccccgcagcccaaaccccgcacgccatgagcccgccgcgggccatacgctggacgagtcggaccgaggctaggacgtggccggcgctctccagccctgcagcagaagaacttcccgtgcgcgcggatcctcgctccgttgcacgggcgccttaagttattggactatctaatatctatgtatttatttcgctggttctttgtagtcacatattttatagtcttaatatcttgtttttgcatcactgtgcccattgcaaataaatcacttggccagtttgcttttctaccatccggctgtggctcagtgagactcctgctgggagggtggaggcccaggaatgggcgggcaggacaccctcatccagtcctgcggggctggtgtgaaaggcgctgggaaccggctttgaatgaataaatgaatcgtgtcatctgc

SEQ ID NO: 22757 - DNA, 5240 bp, Homo sapiens
gaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacg

SEQ ID NO: 22758 - DNA, 5565 bp, Homo sapiens
agcgagctcccggggaaaagcaacggtgtcctcctaagcctgaggccaccgcgaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggagagggcggagctggccgcgggacggaggcacctggcccgccaggcgctctacgccgagctccagacgcagctcgataactgccccgagtcagtgcgggaacagttacaggagcagctgagaagggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtg

SEQ ID NO: 22759 - DNA, 5753 bp, Homo sapiens
actaaactcattgaattagaacagcacttgtccatctcaaagaggataaattattttttgctatccaccccagctggaatttagaccagacttacaggctttctgctccttccttcagtgaagaagagtctccagggtccctctagtgcaggtcaaagaagtccagtccagctgagttcagctccctagggcctccccagccagtctcctggaccaagagctggctttgcaagaaaacatcctactaaagccctgggaaaagagacaaatggtgaagaggagaatgaaaggttgcaggagggagctcctgttttagccctgccacctacctgggggccctctggctaccagtgtccttggaggggcttccttgctgcttctcccactaaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagaagaggtttttccgcttcactatggtgactgagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtg

SEQ ID NO: 22760 - DNA, 5484 bp, Homo sapiens
agcgagctcccggggaaaagcaacggtgtcctcctaagcctgaggccaccgcgaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagagatggagaagctgctgctccctgctgtagacttagagcagtggtaccaggagctgatggccgggctggggactggccccgctgcagcctcccctcactcttctcccccgcctctgcccgccaaagcttcccgtcagctgcaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaaggtcgagtcgcttcccgccgagcccctcccaaccgacgacccagcaggacaacaagtgattgaagagcagcggcggcgactggctgagctgaagcagaaagcggcagctgaggcacagtgccagtgggatgcccttcacggggcagcacccttcccagcgggcccctcgggcttcccccctctcatgcaccactctatcctacaccacctgcctgcggggcgggagcgtggggaggagggtgagcacgcctatgatacgctgagtctggagagctctgacagcatggagaccagcatctccaccgggggcaactcggcctgctcccctgacaacatgtccagcgcgagtggtctggacatggggaagatcgaggagatggagaagatgctgaaagaggctcatgcagagaagaaccggctcatggagtcgagggagcgggagatggagctgcggcggcaggccctggaggaggagcggcggaggcgtgagcaggtagaacggaggctgcagagtgagagtgcccggaggcagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacggaagtg

SEQ ID NO: 22761 - DNA, 1940 bp, Homo sapiens
ctgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacgg

SEQ ID NO: 22762 - DNA, 1315 bp, Homo sapiens
aggccaccgcgaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggcgccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcagcacgaagatgcacctagcaccaagctccagggagaggtgctagccctggaagaagagcgggctcaggtgctggggcacgtggagcagctcaaggtccgtgtgaaggagctagagcagcagctgca

SEQ ID NO: 22763 - DNA, 4783 bp, Homo sapiens
aggccaccgcgaccgagccgagccaggctaagggaccagtgtctccctgccccccccccacctctaggagctctggagccttaggaccatggacgctctcaataggaaccaaataggccctggatgccagacccagaccatggtgcagaaaggacccttggacctgatcgagacaggcaaagggctgaaagtgcaaacggacaaaccccacctggtgagcctgggcagtgggcgactcagcacagccatcaccctcctgccgctggaggaagggaggacggtgattggctctgcagccagagacatctcactacagggcccaggcctggctccagagcactgctacatcgagaacctgcggggcaccctcaccctctacccctgtggcaatgcctgcactattgatgggctccctgtccggcagcctacccggctcactcagggctgcatgttgtgcctgggtcagtccaccttccttcgctttaaccacccggctgaagccaagtggatgaaaagcatgattccagcagggggccgagcccctgggcccccctacagccctgttcctgcagaatcagaaagtctggtaaatgggaaccacaccccacagactgcaacacggggaccctctgcctgtgccagccacagttccctggtgagctctattgagaaggacctgcaagagatcatggactcactggtgctagaggagcctggagctgctggcaagaagcctgccgcaacctctccactgtcaccgatggctaatggtgggcgctacctgctgtctcccccaaccagccccggccatgtctgtgggctccagctatgagaacacctctccagccttctctccactctcttcaccagccagcagtggaagctgtgccagtcactcacccagtgggcaagagccaggaccttctgtgcccccgctggtacctgcccgttcctccagctaccatctggccctacagcccccacagtcccgcccaagtggtgctcgctccgagagtcctcggctgagcaggaaagggggccatgagaggcctcccagccctggcctccggggtctgctgacagacagccctgcagctactgtcttggcggaggcccggagagccactgagagcccccggctgggtgggcagctgcctgtggtggccatcagcctgagtgaatacccagcttctggtgctctcagtcaacccaccagcattcctggcagccccaagtttcagcctccagtccctgctccccgaaacaagattggcacactccaggaccgccctcccagccctttccgtgagcctccaggcagtgagcgggtgctaacaaccagcccctcacgccaactggtgggccgaacattttcagatgggttagccacccgtaccctgcagcctcctgagagtccccgcctgggccggcggggcctggacagtatgcgagaactaccccccttaagtccatctctgtcccggcgagctctctccccgctgcccacccggaccaccccagatcccaagctaaacagggaagtggcagagagtcctcggccccggcgctgggcagcccatggggcttcaccagaggacttctccctgacgctgggggcacggggccgtaggacacggagcccctcacccacactgggtgagtctctggcaccccacaagggcagcttcagtggcaggctgagcccagcctacagtctgggctctcttactggggcttcaccctgccagagtccctgtgtccagaggaagctctccagcggggacttgcgggtgcctgtcacaagggagcggaaaaatagcatcacagagatcagtgacaatgaggacgacctcctggagtaccaccggcgacagcgccaagagcggctccgggagcaggagatggagaggctggaacgccagcgcctggagaccatcctgaacctgtgtgccgaatacagccgggctgatgggggacctgaggctggggagcttcccagcattggggaggccaccgcagcattggcactggcaggccggaggccctcacgaggccttgcaggggcctctgggcggagcagcgaggagcctggcgttgccacccaacgcctatgggagagtatggagcgctcagatgaggaaaatctcaaggaggagtgcagcagcactgagagcacccagcaggagcacgaagatgcacctagcaccaagctccagggagaggtgctagccctggaagaagagcgggctcaggtgctggggcacgtggagcagctcaaggtccgtgtgaaggagctagagcagcagctgcaggagtcagcccgagaggccgaaatggagcgggcactgctgcagggagagagggaggcagagcgggcactgctgcagaaggagcagaaggcagtggatcagctgcaggagaagctggtggccttggagacaggcatccagaaggagagggacaaggaggcagaggccctggagactgagacaaagctctttgaggacttggagttccagcagttggagcgggagagccgcgtggaggaggagcgcgagctggccggccaggggctgctccggagcaaggctgagctgctccgcagcatcgccaagaggaaggagcgcctggccatcctggacagtcaggctgggcagatccgggctcaggccgtgcaggaatcagaacgcctggcccgggacaagaatgcctccttacagctgctgcaaaaggagaaggagaagctgactgtgctggaaaggagataccactcactcacagggggcaggcctttcccgaagaccacatcgaccctcaaagaggtttaccgctccaagatggatggcgaggccaccagcccccttccccggacccgcagcggccccctcccctcctcctctggctcttcctcctcctcctcccagctcagcgtggctaccctggggcgtagcccctccccaaagagcgctctactcacccagaatggcacgggcagccttcctcgcaacctggcagccacactgcaggacatcgagaccaagcgccaactagctctgcagcagaagggacaacaagtgattgaagagcagctggtcgagaaggaggtcaagatgcgggagaaacaattttcccaggcacgacccctgacccgctacctgccaatccggaaggaggactttgacctgaagacacatattgagtcatcgggccatggtgttgatacctgcctgcacgtggtgctcagcagcaaggtctgccgtggctacttggtcaagatgggcggcaagattaaatcatggaagaagcgctggtttgtcttcgaccggctcaagcgcaccctttcctattatgtggacaagcatgagacgaagctgaagggagtcatctatttccaggccattgaggaagtgtactacgaccacctgcgcagtgcagccaagagcccgaacccagccctcaccttctgcgtaaagacccatgaccggctgtactacatggtggccccatctgcagaggccatgcgtatctggatggatgtcattgtcacaggggctgagggctacactcagttcatgaactaactgccgtgggcctcctggcagagcacaactggggcttttgtataagaagactttaatattctgtaaggagcttggtcctgtgagtttctgggctctggcctcctgaagaaccagccagaagaagaaaagtagaggtggctttgctgcctcctgggagcccagaacttgcagtaaccctttagggtcctgccccaggcccagccagggctgaggagctgtcacagagagggcctcagctctgacctgacacctgctctccccagcctgttttctcttttctaaaagacaaattatggtaccataagctgccaaagatcccctcctgcctcagacccctttgccaggggctttgggggctgagcagagccacatccagagtggggtaatagctcaggcggcccgcttcccatttctcaaaccccgctctgccccattgttctcctttcccttatactttttattaccttgctcaagggccagagatctcaagtgtcaaccttgaggtcccagctccatcccctagttgcagactcatcaccatggttaccatagtgactgcttcattgccatggttacatactaattgctgcagctctgtggcccagcccactgcttcagctgtgggccatctgagggtacgtgccatcatctctccagcccaggcccctgggcatctcatgctggggggaagggactgaatacctttttccttccccctgcctgtgtcttcagccctgatgcacaggctgccagccccccagtccagccctctcccttccactggtgccttgcttagagccagaagggatgaagccgggggatctatggaacagaggaggagcgatgcagttgggagaggaagctagaagggttatggttggagttctgtacagtgttgagtttccgacagggaaagaggattcctccaatgctcctagagagaaagcctgagcaggagatgatgcagcagaggggaagggccctgtggtgccgccgcccttccttcagcctccgaagggtgatggaaatggagagtggaggaccaggcctccagctgtctggcctcgcccttcacgccttaacactaagcccacctcccctgctctccttcccagcattgagcccttggttgcctgggcccaggctgggggttttcagtatttgtaagcatttcagcagaacaataaagcctttggactacg

SEQ ID NO: 22764 - DNA, 15249 bp, Homo sapiens
gagcccgcgccctcacgctcagcaccccagcctgcctgcccgcccgcctgccctgccgctgcccgctgtcacaccctgtagcgcgggagcttctcgcagcgccccgggccttctcgtggtaccctgcctgctgcctttgcccccgcactgactgcccggctccagcagccatggtggccggcatgctcatgccacgggaccagctgcgggccatctatgaggtgctcttccgcgagggcgtgatggtggccaagaaggaccggcggccccgcagcttgcacccccatgtgcccggcgtcaccaacctgcaggtcatgcgtgccatggcgtccctgcgggcacggggcctggtccgcgagacctttgcctggtgccacttttactggtacctcaccaatgaaggcatcgcccacctccgccagtacctgcacctgccgccagagatcgtgcccgcctctctgcagcgcgtgcgccgccccgtcgccatggtgatgcccgcacgccgcaccccccacgtgcaggctgtgcagggtcccctgggctccccacccaagcgggggccgctgccgacggaggagcagcgggtctaccgtcggaaggagcttgaggaggtgtcacctgagacccctgtggtgcctgctaccacccagcggaccctggccaggccaggcccggagcctgccccagccacagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 22765 - DNA, 14797 bp, Homo sapiens
tgagctgagcctgtgccgagtgagcgtctcgtggggccgccagccttcagctgcctgtgtgccacacggggctgcccagagcaccgtgcctgaggccgagggtccgggcgacgaaggtgtgggggcagcatgtctcagcaccagctccgcgtgccgcagcccgagggcctgggccgaaagagaaccagctcggaggacaacctgtacctggctgtgctcagggcctctgagggcaagaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 22766 - DNA, 14736 bp, Homo sapiens
gctgtctagcctggagcagccggttcccagcgcaggaagggcagccctggcggctccgcgtggcggctatggagccctcgggcagcctgtttccctccctggtggttgtgggtcacgttgtcaccctggccgctgtgtggcactggcgcaggggacgtcggtgggcgcaggacgagcaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 22767 - DNA, 14751 bp, Homo sapiens
attgatcagctgaagccccgcccctggccggcaagccctgccccggacctccgggctcctcccccggctgcggcgctggcctgggcagtgcggtgcggggctggactctgcctggtggtggcacagccgccctcagccccggcgcagacatggacccctcgcgagccatccagaacgagatcagctccctcaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 22768 - DNA, 14683 bp, Homo sapiens
agagtggccgccgggtgctggaggctccgctgcaccccgcgccccgcgcccgccggcatggccggcccgctgcccgacgagcaggacttcatccaggcctacgaggaggtgcgcgagaagtacaaagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 22769 - DNA, 14689 bp, Homo sapiens
gtggccggcatgtcgggggcggggggcgcctttgcctcgccgagggaggtcttgctggagcggccgtgctggctggacgggggctgcgagccggcccgcaggggctacctctaccagcagctgtgctgcgtagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 22770 - DNA, 14646 bp, Homo sapiens
cctccgaggggcctgtgacctcccacacccctggcccgctccgtctgccccgtgggctcctgccaccgtccccgatgaagatcgtgcccgatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 22771 - DNA, 14787 bp, Homo sapiens
ggcggcagagctgaagtgagcggagccaccaggaggccatgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggtgagggccaacgagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctgaggctgcctgcgcccaccccgctctgcatgcggcccagcccggctcccaccgaggcgcgggggccgttttcaacgcttaaaggtgtcttcctcccaagtggtgcctaaagtttaaccaaaaagaccagactaatatattaatatatatctgctgtccagacagcctgtatcttgggggacagggctggcccagccctgctggccgcctcaccccctcgggtctcctcactcccttctacctgccactcacacagccaggtgccttggagggtcccaagctgggccccagcccaccctcctgtcttcccagggtagcccgcctgccagtcctagctgcacagggcagctgggcccaaccctgtctgtagagggccctggtgtttctagcactggcctgcacggtgggccttgctggggacggggggccccagtcagcctctctcccagtctacccagagaagccccttccccatgggaagacgaggccctcgggcccagcccccacagtgctgtctgatctgtgctttccagctcaccccccacactcactcctgagacccctggcctccggcgtcagcctccagcctctgttcccctagtaagtgccttccatgtcggcctctaaccccaggccccgaggacccagacccagtggggaggcggacgttccagccggcatggctgggaactgcagacctgtcctcctggtgggtccaggggcccctccagcttgtggagccccacactggggtgccgcctgcccgtctctctcccatggagccccagccccctttgggcccagggacaccagccaggctctgtgctgaccctcctgttgcacccagccctggtctcagcagcgaccacccctgcctccaccctctgagctttgcatgttccactaaccccgggcgggtggcaggtggaggtgtcaggctgctggcgcctctgcaagggcagaacactaacctgaccgtgggcggggccttgcggtatccgcccccaataaaagcaattccaacctt

SEQ ID NO: 22772 - DNA, 13713 bp, Homo sapiens
atgtcgggtgaggacgctgaggtccgggcagtctctgaagatgtctccaatggaagcagtggctcgcccagccctggggacacactgccctggaaccttgggaaaacgcagcggagccggcgcagcgggggtggcgctgggagcaacgggagtgtcctggacccagctgagcgggcggtcattcgcatcgcagatgagcgggatcgtgtgcagaagaaaaccttcaccaagtgggtcaacaagcacctcatcaaggcccagaggcacatcagtgacctgtatgaagacctccgcgatggccacaacctcatctccctgctggaggtcctctcgggggacagcctgccccgggagaaggggaggatgcgtttccacaagctgcagaatgtccagattgccctggactacctccggcaccgccaggtgaagctggtgaacatcaggaatgatgacatcgctgacggcaaccccaagctgacccttggcctcatctggacaatcattctgcacttccagatctcagatatccaggtgagtgggcagtcggaggacatgacggccaaggagaagctgctgctgtggtcgcagcgaatggtggaggggtaccagggcctgcgatgcgacaacttcacctccagctggagagacggccgcctcttcaatgccatcatccaccggcacaagcccctgctcatcgacatgaacaaggtgtaccggcagaccaacctggagaacctggaccaggccttctctgtggcggagcgggacctgggagtgacgcggctcctggaccctgaggacgtggatgtccctcagcccgacgagaagtccatcatcacctacgtctcgtcgctgtatgacgccatgccccgcgtgccggacgtgcaggatggggagctgcagctgcgctggcaggagtaccgggagctggtgctgctgctgcttcagtggatgcgacaccacacggccgcctttgaggaacgcaggttcccctccagcttcgaggagattgagatcctgtggtctcagttcctgaagtttaaggagatggagctaccagccaaggaggccgacaagaacaggtccaagggcatctaccaatccctggagggagcggtgcaagcaggccagctcaaggtgccccctggctaccacccgctggatgtggagaaggagtggggcaagctgcacgtggccatcctggagcgggagaagcagctccgcagcgagtttgagaggctggagtgtcttcagcgcatcgtgaccaagctgcagatggaggcggggctgtgtgaggagcagctgaaccaggccgacgccctgctgcagtcggatgtccggctgctggctgcaggcaaagtgccacagcgggcgggggaggtggaacgggacttggacaaggcggatagcatgatccggctgctcttcaacgacgtgcagaccctcaaggatggacggcacccgcagggcgagcagatgtaccgcagggtgtaccgtctgcacgagcgcctggtagccatccgcaccgagtacaacctacggctgaaggcaggcgtggcggcccctgcaacccaggtggcccaggtgactctgcagagtgtgcagaggcgccccgagctggaggactccactctgcgctacctgcaggacctgctggcctgggtggaggagaaccagcaccgtgtggatggcgctgagtggggtgtggacctgcccagcgtggaggcgcagctgggcagccaccgaggcctgcaccagtccatcgaagaattccgggccaagatcgagcgggcacggagtgacgagggccagctctcccccgccacccggggtgcctaccgtgactgcctgggtcggctggacctgcagtacgccaagctgctgaactcctccaaggcccgcctcaggtccctggagagcttgcacagctttgtggcagccgccactaaggagctaatgtggctgaatgagaaggaggaggaggaggtgggcttcgactggagcgaccgcaacaccaacatgaccgccaagaaggagagctactcggcgctgatgcgggagctggagctgaaggagaagaagatcaaggagctccaaaatgctggggaccggctgctgcgggaggaccacccggcccggcccacggtggagtccttccaggcggccctgcagacgcagtggagctggatgctacagctgtgctgctgtatcgaggcacacctgaaggagaacgctgcctactttcagttcttctcagatgtgcgggaggccgaggggcagttgcagaagctgcaggaggcactgcgtaggaaatacagttgtgatcgctccgccaccgtcacccggctggaggacctgctgcaggatgcccaggacgagaaggaacagctgaacgagtacaagggccacctctcaggcctggccaagcgggccaaggccgtcgtgcagctgaagccccgccacccagcccaccccatgcggggccgcctgcccctgctggccgtgtgcgactataagcaggtggaggtgactgtgcacaagggtgacgagtgccagctggtgggccctgcacagccgtcccactggaaggtgctcagcagctccggcagcgaggccgccgtgccctccgtgtgcttcctggtgcccccgcccaaccaggaggcccaggaggccgtcaccaggctggaggcccagcaccaggccctggtcacgctgtggcaccagttgcacgtggacatgaagagccttctggcctggcagagccttcgccgcgacgtgcagctcatccgctcctggtccctggccacgttccgcaccctgaagccagaggagcagcgccaagccctgcacagcctggagctgcactaccaggccttcctgcgggacagccaggacgcgggcggcttcggacccgaggaccggctgatggctgagcgcgagtacggctcctgcagccaccactaccagcagctgctgcagagcctggaacagggtgcacaggaagagtctcgctgccagcgctgcatctccgagctcaaagacatccggctgcagctggaggcctgtgagacgcgcaccgtgcaccgcctgcggctgccgctggacaaagagccggcacgggagtgtgcccagcgcatcgccgagcagcagaaggcacaggcagaggtggaggggctgggcaagggggtcgcccggctctctgccgaggccgagaaggtcttggccctaccagagccatcgcctgcggcccccacgctgcgctcggagctggagctgacgctgggcaagctggagcaggtccgcagcctgtctgccatctacctggagaagctcaagaccatcagcctggtgatccgcggcacgcagggggccgaggaggtgctcagggcccacgaggagcagctcaaggaggcccaggccgtgccggccaccctcccggagctcgaggccaccaaggcctctctgaagaagctgcgggcccaggccgaggcacagcagcccacgttcgacgccctgcgggatgagctgcggggggcacaggaggtgggggagcgactgcagcagcggcacggggagcgggacgtggaggtggagcgctggcgggagcgggtcgcccagttgcttgagcgctggcaggctgtgctggcccagaccgacgtgcggcagcgcgagctcgagcaactgggccgccagctgcgttactaccgcgagagtgcagaccccttgggcgcctggctgcaggacgccaggcggcggcaggagcagatccaggccatgccgctggccgacagccaggctgtgcgggagcagctgcggcaggagcaggccctgctggaggagatcgagcgccacggcgagaaggtcgaggagtgccagaggtttgcgaaacagtacatcaacgccatcaaggactatgaactccagctggtgacgtacaaggcgcagcttgagccggtggcctccccggccaagaagcccaaggtccagtcgggatcagagagtgtcatccaggagtacgtggacctgcgtacgcactacagcgagctgaccacactgacgagccagtacatcaagttcatcagcgagactctgcggcgcatggaggaggaggagaggctggctgagcagcagcgggcagaggagcgcgagcggctggccgaggtggaggccgcgctggagaagcagcggcagctggccgaggcgcacgcccaggcaaaggcacaggcggagcgggaggcgaaggagctgcagcagcgcatgcaggaggaggtggtgcggcgggaggaggcggcggtggacgcgcagcagcagaagcgcagcattcaggaggagctgcagcagctgcggcagagctcggaggcggagatccaggccaaggcccggcaggcagaggcggctgagcgcagccggctgcgcatcgaggaggagatccgcgtggtgcgcctgcagttggaggccaccgagcgccagcgtggcggggctgagggggagctgcaggcactgcgtgcacgggcggaggaggctgaggcacaaaagcgacaggcgcaggaggaggccgagcgcttgcggaggcaggtgcaggacgagagccagcgtaagcggcaggcggaggtggagctggcctcgcgcgtgaaggccgaggccgaggcggcgcgcgagaagcagcgggccctgcaggccctggaggagctgcggctgcaggcggaggaggcggagcggcgcctgcggcaggccgaggtggagcgagcgcggcaggtacaggtggccctggagacggcgcagcgcagtgcagaggcggagctgcagagcaaacgcgcctccttcgccgagaagacggcacagctggagcgctccctgcaggaggaacacgtggctgtggcacagctgcgggaggaggctgagcggcgggcacagcagcaggccgaggccgagcgggcgcgcgaggaggcagagcgggagctggagcgctggcagctcaaggccaacgaggcgctacggctgcggctgcaggcggaggaggtggcgcagcagaagagcctggcgcaggccgaggctgagaagcagaaggaggaggcggagcgcgaggcgcggcggcgcggcaaggcggaggagcaggccgtccggcagcgggagctggctgaacaagagctggagaagcagcggcagctggcggaaggcaccgcgcagcagcgcctggccgcggagcaggagttgatccggctgcgggccgagacggagcagggggagcagcagcggcagctgctggaggaggagctggcccggctgcagcgtgaggcggctgcagccacgcagaaacggcaggagctggaagccgagctggccaaggtgcgggccgagatggaggtgctgctggccagcaaggcgagggctgaggaggagtcgcgctccaccagcgagaagtccaagcagaggctggaggccgaggccggccggttccgcgagctggccgaggaggccgcccgcctgcgtgccctggcggaagaggccaagcggcagcggcagctggccgaggaagacgcggcgcggcagcgggccgaggcggagcgggtgcttgcggagaagctggccgccatcggcgaggccacgcggctcaagacggaggcggagatcgcgctcaaggagaaggaggcggagaacgagcgcctgcggcggctggcggaggacgaggccttccagcggcggcggctggaggagcaggccgcgcaacacaaggctgacatcgaggagcgcctggcccagctgcgcaaggcatcggacagcgagctggagcggcagaaggggctggtggaggacacgctgaggcagcggcggcaggtggaggaggagatcctggcgctgaaggcgagcttcgagaaggcggccgctggcaaggcggagctggagctggagctgggacgcatccgcagcaacgcggaggacacgctgcgcagcaaggagcaggccgagctggaggctgcgaggcagcggcagctggcggcggaggaggagcggcggcgccgtgaggctgaggagcgcgtgcagaagagcctggcggccgaggaggaggccgcacggcagcggaaggcggcgctggaggaagtcgagcggctgaaagccaaggtggaggaggcgcggcgcctgcgggagcgagcggagcaggagtcggcgcggcagctgcagctggcccaggaggccgcccagaagcggctgcaggcggaagagaaggcacacgccttcgcggtgcagcagaaggagcaggagctacagcagacgctgcagcaggagcagagcgtgctggaccagctgcgcggcgaggcggaggcggcccggcgggcggctgaggaggcggaggaggcccgggtgcaggcggagcgtgaggcggcgcagtcccggcggcaggtggaagaggccgagcggctgaagcagtcggcagaggagcaggcacaggcccgggctcaggcacaggcggctgcagagaagctgcgcaaggaggccgagcaagaggcggcgcggcgggcacaggcggagcaggcggccctgcggcagaagcaggcagctgacgcggagatggagaagcataagaaattcgccgagcagacgctgcggcagaaggcgcaggtggagcaggagctgacaacactgcggctgcagctggaggagaccgaccaccagaagaacctgctggacgaggagctgcagcggctgaaggcggaggccacggaggccgcacgccagcgcagccaggtggaggaggagctcttctcggtgcgcgtgcagatggaggagctgagcaagctcaaggcacgcatcgaggctgagaaccgcgcactcatcttgcgtgacaaggacaatacgcagcgcttcctgcaggaggaggctgagaagatgaagcaggtggcggaggaggccgcgcggctgagtgtggcggcccaagaggctgcgcgactgcggcagctggcagaggaggacctggcacagcagcgggccttggcagagaagatgctcaaggagaagatgcaggcggtgcaggaggccacgcgactcaaggctgaggcggaactgctgcagcagcagaaggagcttgcgcaggagcaggcgcggcggctgcaggaggacaaggagcagatggcgcagcagctggcggaggagacgcagggcttccagcggacgctggaggccgagcggcagcggcagctggagatgagcgctgaggctgagcgcctcaagctgcgtgtggccgagatgagccgagcccaggcccgcgctgaggaggacgcccagcgcttccggaagcaggcggaggagatcggtgagaagctgcaccgcacggagctcgccacccaggagaaggtgaccctggtgcagacactggagatccagcgacagcagagtgaccatgatgccgagcgcctgcgggaggccatcgctgagctggagcgtgagaaggagaagctccaacaggaggccaaactgctgcagctcaagtctgaggagatgcagacggtgcagcaggagcagctgctgcaggagacgcaggccctgcagcaaagcttcctctctgaaaaggacagcctgctacagcgggagcgcttcatcgagcaggagaaggccaagctggagcagctcttccaggacgaggtggccaaggcacagcagctgcgtgaggagcagcagcggcagcagcagcagatggagcaggaacggcagcggctggtggccagcatggaggaggcgcggcggcggcagcatgaggccgaggagggcgtgcggcgcaagcaggaggagctgcagcagctggagcagcagcggcggcagcaggaggagctgctggctgaggagaaccagaggctgcgtgagcagctgcagctcctggaggagcagcaccgggccgcgctggcgcactcagaggaggtcactgcctcgcaggtggctgccacaaagaccctgcccaatggccgggatgcacttgatggccccgcggcagaggcagagccggagcacagcttcgatggcctgcggcggaaggtgtcagctcagaggctgcaggaggccggcatcctgagtgcggaggagctgcagcggttggcgcagggccacaccacggtggacgagctcgcacggcgggaagacgtgcgccactacctgcagggccgcagcagtatcgcagggctgttgctgaaggccaccaatgagaagctgagtgtttacgccgccctgcagaggcagctgctgagtcccggcacggccctcatcctgctggaggcgcaggcggcctcaggcttcctgctggaccctgtgcggaaccggcggctgaccgtcaacgaggctgtgaaggagggtgtggtgggccccgagctgcaccacaagctgctgtcggccgagcgcgccgtcactggctacaaggacccctacactggccagcagatctctctcttccaagccatgcagaagggcctcatcgtccgggagcacggcatccgcctgctggaggcccagatcgccacgggcggcgttatcgaccccgtgcacagccaccgcgtgcccgtggacgtggcctaccggcgcggctacttcgacgaggagatgaaccgcgtcctggcggaccccagcgacgacaccaagggcttctttgaccccaacacgcacgagaacctcacgtacctgcagctactggagcgctgcgtggaggaccccgagacgggcctgtgccttctgccactcacggataaggctgccaagggcggggagctggtctacactgactccgaggcccgggacgtctttgagaaggccaccgtgtctgcgccgttcggcaagttccagggcaagacggtgaccatttgggagatcatcaactcggaatacttcacggcagagcagcggcgggacctgctgcggcagttccgcacgggccggatcacagtggagaagatcatcaagatcatcatcacggtggtggaggagcaggagcagaagggccggctttgctttgagggcctgcgcagcctggtgccagccgccgagctgctggagagcagggtcatcgaccgcgagctctaccagcagctgcagcgaggtgagcgctctgtgcgagacgtagccgaggtggacactgtgcggcgggctctccggggtgccaacgtcatcgcgggtgtatggctggaggaggcggggcagaagctgagtatctacaatgccctgaagaaagacctgctgccatccgacatggccgtggccctgttggaagcccaggccggcaccgggcacatcatcgaccccgccaccagcgcccggctgaccgtggacgaggcagtgcgtgctggcctggtgggccccgagtttcatgagaagctgctatcagccgagaaggctgtgacagggtacagggacccctacacagggcagagcgtctccctgttccaggccctgaagaagggcctcattccccgggagcagggcctgcgcctgttggacgcccagctgtccacgggcggcatcgtggaccccagcaagagccaccgcgtgcccctggatgtcgcctgcgcccgaggctgcctggatgaggagaccagcagggccctgtcggcaccaagggccgacgccaaggcctacagtgaccccagcacaggggagccggccacctacggcgagctccagcagcggtgccggcccgaccagctgaccgggctgagcctgctgccgctctcagaaaaggctgctcgggcccggcaggaggagctctactcagagctgcaggcccgtgagacctttgaaaagaccccggttgaggtccccgtgggtggcttcaagggcaggacggtgacggtgtgggagctcatcagctctgagtacttcactgcggagcagcggcaggagctgttgcgtcagttccgcacgggcaaggtcaccgtggagaaggtcatcaagattctcattaccatcgtggaggaggtggagaccctgcggcaggagaggctgtccttcagcggcctccgtgcccctgtgccagccagcgagctcctggcttccggggtcctcagcagagcccagtttgagcagctcaaggacggcaagacgacggtcaaggacctttcggagctgggctccgtgcggacgctgctgcagggcagtggctgcctcgccggcatctacctggaggacaccaaggagaaggtgtccatctacgaggccatgcgccggggcctgctgagagccacaacggctgcgctcctgctggaggcgcaggcggccactggcttcctggtggaccccgtgcggaaccagcgcctgtatgtccacgaggccgtgaaggcgggcgtggtgggccccgagcttcacgagcagctgctgtctgccgagaaggccgtcaccggctacagagacccctactcgggcagcaccatctccctcttccaggccatgcagaagggcctggttctccggcagcacggcatccgcctgctggaggcccagatcgccacgggcggcatcatcgaccccgtgcacagccaccgcgtgcctgtggacgtggcctaccagcgcggctacttcagtgaggagatgaaccgcgtcctggcggaccccagcgacgacaccaagggcttctttgaccccaacacgcatgagaacctcacgtacaggcagctgctggagcggtgcgtggaggaccccgagacgggcttgcgccttctgccactgaaaggggcggagaaggctgaggtggtggagaccacgcaggtgtacactgaggaggagacaagaagggcatttgaagagacacagatcgacattcccggcggcggcagccacggcggctccaccatgtccctgtgggaggtgatgcagtcggacctgatccccgaggagcagcgggcccagctgatggctgacttccaggccggccgggtgaccaaggaacgcatgatcatcatcatcatcgagatcattgagaagacagagatcatccgccagcagggtctggcctcctacgactacgtgcgccgccgcctcacggctgaggacctgttcgaggctcggatcatctctctcgagacctacaacctgctccgggagggcaccaggagcctccgtgaggctctcgaggcggagtccgcctggtgctacctctatggcacgggctccgtggctggtgtctacctgcccggttccaggcagacactgagcatctaccaggctctcaagaaagggctgctgagtgccgaggtggcccgcctgctgctggaggcacaggcagccacaggcttcctgctggacccggtgaagggggagcggctgactgtggatgaggctgtgcggaagggcctcgtggggcccgagctgcacgaccgcctgctctcggctgagcgggcggtcaccggctaccgtgacccctacaccgagcagaccatctcgctcttccaggccatgaagaaggagctgatccctactgaggaggccctgcggctgctggatgcccagctggccaccggcggcatcgtggacccccgcctgggcttccaccttcccctggaggtggcttaccagcgtggctacctcaacaaggacacgcacgaccagctgtcagagcccagcgaggtgcgcagctacgtggacccgtccaccgacgagcgcctcagctacacgcagctgctcaggcggtgccgtcgtgacgacggcaccggccagctgctcctgccactgtcggacgcccgcaagctgaccttccgtggcctgcggaagcagatcaccatggaggagctggtgcgctcgcaggtcatggacgaggccacggcgctgcagctgcgggagggcctgacctccatcgaggaggtcaccaagaacttgcagaagttcctggaaggcaccagctgcatcgctggtgtcttcgtggacgccaccaaggaacggctctcggtgtaccaggccatgaagaagggcatcatccgccccggcacagcctttgagctcctggaggcgcaggcggccaccggttacgtcatcgaccccatcaagggactgaagctgacggtggaggaggctgtgcgtatgggcattgtgggccccgagttcaaggacaagctgctgtcggccgagcgcgccgtcactgggtacaaggacccctactctgggaagctcatctccctcttccaggccatgaagaagggcctgatcctgaaggaccatggcatccgcctgctggaggcccagatcgccacgggcggcatcatcgaccctgaggagagccaccggctgcccgtggaggtggcctacaagcgcggcctcttcgatgaggagatgaacgagatcctgaccgacccctcggacgacaccaagggcttctttgaccctaacacggaggagaacctcacctacctgcagctgatggagcgttgtatcactgacccccagacgggcctgtgtctcttgccgctgaaggagaagaagcgggagcggaagacgtcctccaagtcctccgtgcgcaagcgccgagtggtcatcgtggaccccgagacgggcaaggagatgtcagtgtacgaggcctaccgcaagggcctgattgaccaccagacgtacctggagctgtccgagcaggagtgcgagtgggaggagatcaccatctcctcctcggacggcgtggtcaagtccatgatcatcgaccgccgctccgggcgccagtacgacatcgatgatgccatcgccaagaacctcatcgaccgctcggcactggaccagtaccgcgccggcacgctctccatcaccgagttcgccgacatgctctcgggcaacgccggtggtttccgctcccgttcctcctcggtgggatcctcctcctcctaccccatcagccccgccgtctccaggacccagctggcctcctggtcagaccccactgaggagacgggccccgtggctggcatcctggacacggagacgctggagaaggtgtccatcaccgaggccatgcaccggaacctggtggataacatcacggggcagcggctgctggaggcgcaggcctgcaccgggggcatcatcgaccccagcaccggtgagcgcttccctgtcaccgacgccgtcaacaagggcctggtggacaagatcatggtggaccgcatcaacctggcccagaaggccttctgcggcttcgaggacccacgcaccaagaccaagatgtcggccgcccaggccctgaagaagggctggctctactacgaggccggccagcgcttcctggaggtgcagtacctgaccggcggcttgatcgagcccgacacgccgggccgcgtgcccctggacgaggccctgcagcgcggcacggtggacgcccgcaccgcacagaagctgcgtgacgtgggcgcctactccaagtacctcacctgccctaagaccaagctcaagatctcctataaggacgcgctggaccgcagcatggtggaggagggcacggggctgcggctgctggaggctgccgcgcagtccaccaagggctactacagcccctacagcgtcagcggctccggctctaccgctggctcccgcaccggctcgcgcaccggctcccgggccggctcccgccgcggcagctttgacgccaccggctccggcttctccatgaccttctcttcatcctcctactcctcctcgggctacggccgccgctacgcctcggggtcctcggcctccctggggggccctgagtctgccgtggcctga

SEQ ID NO: 22773 - DNA, 7322 bp, Homo sapiens
ggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcggttgcctcttggtgctgccttggccgtatttggcacccagaatgcttcattctgtgacggtctattaataaggttgccttgctagagtttggagcagggcctcagattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaatagaaactagcttttaaactgagctttggaaccatttgtgttcagttaagtttacctgggtattttgtcctgattcactgccaattgtcacattttaagacttttttttttccatataggaaagccattattagtagtaaacttttacaaatcccattttcaaattacttttagatcttaaaattttcatttttgtctaataacagtggctctaccttttgacatctggctcattaaaaaatttagcaatagaatgtaaattgtataaaaagtttgtgaataactcaagggtttaaattttcttactagcttctaaatggattaataatcaagtgcttcaaatgaattaagagtccagtttcggaagataataaatgtttgttagatacaccataatttcagatcagtatattctgaagactccctgttgtctggctaaaatatttgccatctttattatgagcctttaaggaaaacaaaccctaaacacaaagcatcagtatttatagcaaaaagagactctgttaggtgacatggcatttcgtgtcacttaatagttggccctaaattagtacacaggatattttgtcgtgtttcatccttcttaacatgctatcttttcatttaataatagtaatagtgtatggcattggggtcttcagagtcgatatataggtagatctctttagtcttttccacctttcacatccaaggggtgggtcaagtgcagccagcaatttattttcattgttggcccacggttagtccataatctagagccattgtggaactgcagccatgaggtgtgtttatcccacagtggattgactcagcctctgtgggtgacagacttctaagcaggaagatagacgtgaagcacatggttacatttgggaacttgtgtagggatcatggcccctgtagccagggttaaaaactggactttttagaagtaaagtaaaagcatatcgcttatatcatttcttgctgaatttgatatgtttttctttcccttaagaatcaaaagcagaaaacaaaaacaacagtcctactccgatgttatctttctgattcaatgtgaatccatctttccttgcaatattttggatggagaatttgaagttaaatgcattagaaaactacctgatgaactaccacaaagttttaagtgactagaaatatatacagtaaaatcccactttcatgcatctctgggaaatgataggagtattgcaaataagttgagtttgtagagggtaacaaagtaaagtaaaacaaacctatcttggttaacatgaaaataacaattgagaatatattatattcactgaataattataggcttttcctcacattagacaaccaacataatcttcttaaaggtctaattaatatatttttctaagggtcagttgggacattaacctaagaaacatatctattaagcacttgttaacaccttattttaggaccctttccgttggggatgggggcaagggtgggaggtttttagaagagtatatatctctttaaaaaaaaacagaaagaaaaatatttctgagcactcattagccctatatggaaacttctttcctttttgtagggccagttatcactgcagattgcaatgtttaccaagaatttctaaaaatgagtgcagattactgaatataatacattatttaaaatatttgggagtagtataatttgtggagaaatgtaaattgtaataatgtaaatgggggcttcaatatatatatataatacacacacacacacacatgcacacataccgcacttcatagaatcaaagttgctctctgaaggagctttggctcctgatattttatcatgctcctatatttttttaatccttggagcagtagtttttatacttatgtatttaaattttattatgaaaaattacatttattaaaaaagtgtgttccaaaggcattaaaattatatatgttaataaggaagtacatttttaaatttttcaaactgctcctagcttttgattaggagaatattttttctgaaagtaggcttttcgctctgcttcattactgcttcctttagtttctatgaaacagattgcttacctaaatctttagttgaatgattagtgttcaatattgctttaatcaccatataaaaggaaaaaaattggtgacagagcacaaatagaaaacctatttttaaatagaaatcacaaatagcaagtgtggaagcactactttattctgtttaaaatgtacttaagaagtcatcaaattagtgaactgagacattggccttagtaggctgtattcactgctaatttaaaaaagggagtaccaggatttattaagtaaagcattttggaaatggggaatagcgccatatatgtatgtatgtgtatgtgtgtgtgtgtgtgtgtatatatacacacacacacacatacttaaatcttgccctgcatgaaattcaaatacatggaggcacatcttcagggcaccagtgttaaaattttggagtcttaattttcatgtgtacacctctttgcctgttcccacccccagacttgaaataacacttcagagtaagagggaattcagctaatttgtttttaaaattgactgtagtggtcactaaaccctttttgagagaatttctattaaagatgaggcagactcgcttatttgaattgcacaatgttctaacaaggatgtaacacagaattggcttttttttccctagaaaaagattgtttgtttctatgtcaactagatatgattaaaaataagtattgccaatgctgttttcattctctagtggccagaatcattatccttgaaatttctggtagtgccttagcttggttaaaaaaaaaaaaaaaaaaaaaaaaaagggattaacattaaataaaagtagtttagaatttgggcctcagacaagatattgaacctcattcagtttcacttccacatgtatgtacaagttaggtcaccaaacacggaagtgtgagtgtggaaggatcttggcactgtaagcaatgctatccattgatgtatacaagtacctttatagttatcgatcactgttaaaactttcattttaaaatcctattaccaagttcagttttttaaaacttcaattgtcctggctgattatgcatcactctgtgtgcaacttttttatttcatttagtgtttctttcaagctgtgtatttttgcctatttgttgcttgtgctttatttttcttagtcatttgtggaatatagtgatatattgtgttaatttggacagtagcggtttttaaaaaccatatactgactgaaacatgagccagagccgattgctttattaagctaataatgaatgttaaagagtacatattttcaggatcgttcatctagtgagcaatacacatattataggccaatatttttttaaaaaatagagcttggtcaacctctatactacacatattacaagatatagcactttcaaaatgaatctaaacctttacagaaactttcttataggttatgccttttattttaagacttattataattcaagtgccattagatgatatatatgtaggcctttgatatataatgctttgtgtacaaaaatggtagatggtattttaaacaggtacatttttacagtgttttcttatcaatttgctatattgcacagaatcagtgtgtgtcttttcataaggttttacaatggtttatttttttacaaggtttacgtgtctcaaagcacactgtcttcccagtacgtaagttaaaaaataccagttcacccaagttgcttctagcctactgagatccatgtgacattggaggagatcttttaaatgtttagtattcgtcattagcaatggctggctgttagttctggtaaatgtgtgcctaagttgaatttgtcttgtttttctcacactgtgtcagcagccatgtctacaacacagataagtctgttgtgatcacatagatctacataagttgtgcagttttgtgctaaaaacccatagggagctcctttgggatcatagaaaagaagatcatgcaaccagcattggtgaaggcacactcagattgcacttagggcctttctatgatgttgtcaaccctctgaggatggaaggcagtgtcttttgatgttatctagcctagaaatgacacagaactattgctaatgtataaaacacttcattatataagcttcagtggtacagatgaaccagaatgaatgtttatcttctcagaaacactccttcaatattatattggatcatgctgctaatgtaacttgggctacaactcttcatggtgctacaaacttctctgtctcattcagtcgtatttttttatccatagaaaaaggactacattaggtgtaaaagtgtacaatatatttttatactgtgacttaatttgtcattaacaaacttttacaccaccacaatgtattcatgtgcacttgcaaaaggagatctcggacatgcaaatgttaccagaacaaacccagcttttgtccacaaggtgactgtaactcagaatggaaagtgggctttataatagggtgtggagtgaagaacatgctgtatgttactaacagccctttgaatttaacaaaaactgggaatccattaggaaacggattgcatcatacctgaacataagctggactgctgaaattgtatttttagctaatgaaaaagtgtttggactagtactctaaaaatgttctaatgataaagttttgagtcaaaatagaaaagaaaaaaatctgcattccaggccgaattttgtatatttttattgcatttaaaattgctattctgtaatattgggaaatcaagtggcttatcatgtatatcgtgtacttaaaatgtattcacaaactactgttgtatttgtataaaatatagacaaagatcatattttttgtgtgtgtataagctctgtaaaatagcaatcacattatgaagctgcagtgatactacattttaaacattcacatccaaagaagcagactatttattgtccatataccagatttaaaatattaatttgctgctaattaaataatagtactgcagcttcttgtggcctacagtgttatgtttgctgtaagaataagatatgtgaattccacaaaatatatgaataaaattatagaatggctttagataa

SEQ ID NO: 22774 - DNA, 1684 bp, Homo sapiens
agctgcaagttgggctgcaggggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcgattggccaaaatgggaaggattggattccactctcttccacgaagagtcaatgggactggctaagatcaaagtctgaggctttttccatcagtaatcaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtaggattctgggacatggattcattacagaaatgtatgtgtagctgtgccctagatgaccatttttattttagtgcctactttaaaacagtataaaaatttctgcttttgtataatacaaattttcattaagccagtataaaataga

SEQ ID NO: 22775 - DNA, 1899 bp, Homo sapiens
agctgcaagttgggctgcaggggcagcgcatacactacaatggctgctggaaagaggcgtaaggaaacaatttccaggcccgccgcgtccagcccgaaatatgagaaaaaaattattagaaattccgcgggcggtgtagaggcggcggacgggccggagggaggatgttaaagccccgcgattggccaaaatgggaaggattggattccactctcttccacgaagagtcaatgggactggctaagatcaaagtctgaggctttttccatcagtaatcagtccctttttgctttcttttacgaccacatgaaacttgagaagccacctaaagctatatcatttagtggagttgggcagttcccaagtgtccaacaagaaggcctggtttaggctgcgatggccactgtcattcctggtgatttgtcagaagtaagagatacccagaaagtcccttcagggaaacgtaagcgtggtgaaaccaaaccaagaaaaaactttccttgccaactgtgtgacaaggcctttaacagtgttgagaaattaaaggttcactcctactctcacacaggagagaggccctacaagtgcatacaacaagactgcaccaaggcctttgtttctaagtacaaattacaaaggcacatggctactcattctcctgagaaaacccacaagtgtaattattgtgagaaaatgtttcaccggaaagatcatctgaagaatcacctccatacacacgaccctaacaaagagacgtttaagtgcgaagaatgtggcaagaactacaataccaagcttggatttaaacgtcacttggccttgcatgccgcaacaagtggtgacctcacctgtaaggtatgtttgcaaacttttgaaagcacgggagtgcttctggagcaccttaaatctcatgcaggcaagtcgtctggtggggttaaagaaaaaaagcaccagtgcgaacattgtgatcgccggttctacacccgaaaggatgtccggagacacatggtggtgcacactggaagaaaggacttcctctgtcagtattgtgcacagagatttgggcgaaaggatcacctgactcgacatatgaagaagagtcacaatcaagagcttctgaaggtcaaaacagaaccagtggatttccttgacccatttacctgcaatgtgtctgtgcctataaaagacgagctccttccggtgatgtccttaccttccagtgaactgttatcaaagccattcacaaacactttgcagttaaacctctacaacactccatttcagtccatgcagagctcgggatctgcccaccaaatgatcacaactttacctttgggaatgacatgcccaatagatatggacactgttcatccctctcaccacctttctttcaaatatccgttcagttctacctcatatgcaatttctattcctgaaaaagaacagccattaaagggggaaattgagagttacctgatggagttacaaggtggcgtgccctcttcatcccaagattctcaagcatcgtcatcatctaagctagggttggatcctcagattgggtccctagatgatggtgcaggagacctctccctatccaaaagctctatctccatcagtgaccccctaaacacaccagcattggatttttctcagttgtttaatttcatacctttaaatggtcctccctataatcctctatcagtggggagccttggaatgagctattcccaggaagaagcacattcttctgtttcccagctccccccacaaacacaggatcttcaggatcctgcaaacactatagggcttgggtctctgcactcactgtcagcagctttcaccagcagtttaagcacaagtaccaccctcccacgtttccatcaagcttttcagtag

SEQ ID NO: 22776 - DNA, 3346 bp, Homo sapiens
attgttcctgcctgattcataaacatcgtgattggcttttgattgctgtcacgtctaatgtggctgctgcctcgtgtcacatctgaaactcatctgtacctcacttagaaagtttctttctataacacaagcctgaacatattgctctcctgattaacaactttcagtggttctgattagacaagacttttcgttgcagtcgacagaaacctaatgggaccattgaagaattccaaacagggtctttataagcttcttctgaaggtctcagacattcagccacggaactcaagtggaatttgtttggataacgtgactgatttcaaagcccggaccccttagacgtgcccatttggtgctgcaagtatttgcataggaatcagaggagttaatcttcttcattccctgacgatgtacaaggtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 22777 - DNA, 4430 bp, Homo sapiens
gattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgaccattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgcaa

SEQ ID NO: 22778 - DNA, 2800 bp, Homo sapiens
tgaataaatcacttaggcgagatataaattggctttgttccatagcagatttgcctttgtactagttaagaaaatcctgaaaagctttccctgtaagaggatcagttggttggaatagccttggtaggaagaagccaagtttgataattacttggtgaacggaaatgctggtttccaaatgctcatcagggttcagtggcacaaagctggctgtagacttggcttctgtagatttggtaaaaacgtaaattcctggggtcccagtgatgctgttttagtctgtactgatttgccctgtggccacccaggaatctgtatttttaaaagttttccatgctgattctaatgcatagccaggtttagtaaccatttaattcagtattcaacttagagacttcaaccttcttgcactgcaaatttgataaatctttgtttatatgaatctcctttgttgagtgccaactggttatttgctgactttctttcaattcagaatttgttttaggttctgttattgcatagatttgcatacctgttttatggtattttaatactgttggttttaaaaaataccatttcctctgagtgctgttctgaatatattatgtaagcaattttgtgtgttcttttttttccacttgcataaagcaggggaaaagttgagagtttttcttaatccagttgcaagtaggacaaaggatatgagtgtttaaagatcatctattaaaatgcatgaaaaaacactagaaaatctcctgtgcacatcgccagtcgtgtgtgtgctctagaagtgaagttcagggggtaacataatggaggaatgttttcctagcttcattccctgacgatgtacaaggtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataaga

SEQ ID NO: 22779 - DNA, 2496 bp, Homo sapiens
gctcaagataaagaccttaaagataactttgtgtgtctctccctttctaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaac

SEQ ID NO: 22780 - DNA, 2942 bp, Homo sapiens
gagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 22781 - DNA, 3404 bp, Homo sapiens
gagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggtatttgcataggaatcagaggagttaatcttgtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 22782 - DNA, 3371 bp, Homo sapiens
gagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcaggattgttcctgcctgattcataaacatcgtgattggcttttgattgctgtcacgtctaatgtggctgctgcctcgtgtcacatctgaaactcatctgtacctcacttagaaaggtatttgcataggaatcagaggagttaatcttgtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 22783 - DNA, 904 bp, Homo sapiens
ggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagattgctgtcacgtctaatgtggctgctgcctcgtgtcacatctgaaactcatctgtacctcacttagaaagacttttcgttgcagtcgacagaaacctaatgggaccattgaagaattccaaacaggtatttgcataggaatcagaggagttaatcttgtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatc

SEQ ID NO: 22784 - DNA, 3418 bp, Homo sapiens
gagccccgcctgcgcgcggcctcctcggcgcagccatcctcttggctgccgcgggcggcaaagcccacggcatctgccatttgtcattcagcccgtcggtaccgccccgagccttgatttagacacggctggggcgtgctctggcctcactctccgggcgggtgctggacggacggacggacggggcagccgtgctcacagctcagcagcgcggggccttggcgcgcggggcgcttccccgggtcgccgtcatggccgcggaggtggcacgcccgagcggcctcgcctgagctccgggggtcgtcgccccgcagggattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggtatttgcataggaatcagaggagttaatcttgtctcttctcacaggtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 22785 - DNA, 2726 bp, Homo sapiens
cttttccgcgccgccgagtcggagctgcgccgcacgcccagcggccgcccggacccgccggccggagctgacccagtgggccacgggctccggactccagaactttccaagcgggggaaacttggcggcgggattgctgtcacgtctaatgtggctgctgcctcgtgtcacatctgaaactcatctgtacctcacttagaaagtcgacagaaacctaatgggaccattgaagaattccaaacaggtatttgcataggaatcagaggagttaatcttgtctcttctcacaggtttgaatcttcagacaaacttctgggaggactcggtccctgcctcgcagcagatgttccctgtcactcagtaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 22786 - DNA, 3277 bp, Homo sapiens
cttttccgcgccgccgagtcggagctgcgccgcacgcccagcggccgcccggacccgccggccggagctgacccagtgggccacgggctccggactccagaactttccaagcgggggaaacttggcggcgggtaggtaggaaaggcagattgttcctgcctgattcataaacatcgtgattggcttttgattgctgtcacgtctaatgtggctgctgcctcgtgtcacatctgaaactcatctgtacctcacttagaaagtggttctgattagacaagacttttcgttgcagtcgacagaaacctaatgggaccattgaagaattccaaacaggtatttgcataggaatcagaggagttaatcttgtttgaatcttcagacaaacttctgggaggactcggtccctgcctcgcagcagatgttccctgtcactcagtagccaatccgggggacccaggacatgccccagctatagtgatgcagattacctttctgctcctgaatcgcacctgtgcctcagactttctcccctcagcttgagactgcatgtaaactgggatgtgtgaaagcaggaagcaaagctagtgacagctgagaggtccatgtctgggtagaaccaggcccacgatgctgcctctcccgtggtctggagttcagctgcagggactctgctgatgtgcccagcaccatcgttctgtttgtgcttaaatggcacagcatttggtcagcacatctgaaaaggaaggtgtgagaagcaaagcccatggccacgttcccctgccagttatgtggcaagacgttcctcaccctggagaagttcacgattcacaattattcccactccagggagcggccgtacaagtgtgtgcagcctgactgtggcaaagcctttgtttccagatataaattgatgaggcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgctgggctataagaggcacctggccctccatgcggccagcagtggggacctcacctgtggggtctgtgccctggagctagggagcaccgaggtgctactggaccacctcaaagcccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 22787 - DNA, 6296 bp, Homo sapiens
tattcttattctctcctcgcattacagcacaaaccagagccttcgcctcctccatggtagaggggcttatgtcccagaaaagactttgtgagagaatttacatttgaggaacttcaggccttgagggggaaaataaggttgggggattaagatgtggacttaatgaaagcctgtttttcactctaaaaattcaagaggacacgctaagaacgatcattgctatttatctgtcttaaattagaaatcatgggcattgtacagttgatttttacttatcatgacttgctcactagaaacttcgtgatctctttctgttatattttaaaaagatgtttttaaatggttttatcttaaagaaatattaggaaaaaaaaaactgaggtagggtccaccatttagaatcagatatctagaatgtaacgtatgttacaattcagagtctctaaaccactctcctaaaatcataatatgagatgattctcagcttgccaaattttctagagttgtgaaataggttatgtcactcaaccagtgtttatttgagggaattcatggttggcagggtccccattatacatcagaagtttttatttcttattttctatcactcatgtaaagattaggatttgtttgaactgcctatttcaagataatgattccaaatcccagccttaaatttcatatctaacatgtttgttgtttttccctgtcccatacattaattctaggttcaaggccatgtcaccctaaagcagccctcacttcttttgcagctgcagtgctgttgcttaaccataactcttggcctctctccagactgtttttttttttttttttttttgcaaaatgtccttgatggtcataatggtgtattttttaaaaattccagttgtttttgtaagttttcttatatcccatcttacattcaattccccctgcaaacctcccactagataaaccacttcccgctctattctttgtcttgagactgacttctaggaaggctgtccacagctgcctcaggccgaaggctaactaggagaatattaggtcgtgtgcttggattcctgttctccaaacgattctaattaaaactagtccactacccccaccaacacgttcagaaggaaaaaaatgtagcagaatccccaaatgccctcatcacttcattataccatttgggtagctttatggcacctgtaggactagttcatgccaggcccatttgtaactgttttctctagttaaacatgatattgccattaacagcacattaaataggattacactgcttaagaatctaggaatttctcaaatatatgagaaaatgtgaaagcacagggataatagaaatttattttataaacacatgctaggagatggaattgtgtcatgatgatccacattaaagaaacatgattgaagtgaatccattatttatactctgactttccattatatatatatattactccaaaagaagttattcatgtttcctaattgtgagcttacccatcgtgtaaaattggccctaacacttattcacaggccacatctacttcgtacatgtactttgcctctgtatgtacacgtgtaacgcataaccgtatatcagctctgcaagatacatagatatccccattttatggtgacggagactgaggcttagagaagttatgcaacttacctaaagttacacaccttccaagcagcagagccagcattcgaacttagacccatctgactccaaagccagtgccctctacactagaccacactgtctttcttaggttggatctaaaaaaatactaccagctggttggttttttaactaactgtaggaacacaacctagtattaagtagagtatgcatgctgcatagtggactgaggtagagtaaaacccattattgtaccacttttaggtaagaaaatgtattatctaaggaatatcattaaaatttccttacttccctccatgaacaaacaaaaaattaaaatgaaagcagtgggggatgaagggaggcggggatcataacataggagtgttaaatattaaaattagaaaagaaaataatttctctatcaatgtttaaaatgctagaaattatgcatgcttatactataacaaagaatactttatttggggaataacttaattgatccatgatgtggcatttaccaaggtaatttttccctttttgttccagcagtaggaattagaggtggttcataaaacacacaatcaccatgtaaattgaaaccgcattaagatcatagtcatcttatgttgtttccctaaaatggttctcatttgccccacatattcaaatcagagtgcacaaagatgttgtgctgagtcagggaagatttagaatgctctgtgaacagttttatactgaacttcagagttcagttattgtacttattttttggtgtgtgtgtgtgcacagttgggttttttgtttgttttgctatttgaattactgtttggccattttaatgtatataactgataaatccaggaggataatctgtatgtctgctctctcagtttctttctataacacaagcctgaacatattgctctcctgattaacaactttcagtggttctgattagacaagacttttcgttgcagtcgacagaaacctaatgggaccattgaagaattccaaacaggcaagtgacaggaacatatttgcatgttagaagaatcagcctggcagcagcattgtgattagaatgaaggggaaccgtccaaaaacagactggggaaccaatatggatctgcctctagcatgcggaaatatctctctacactgacctaactgactcactaagcttgtggtttgtttaaaggaagccacatgaaaattgagtttgggccaatagagtgaactcgttctccattctctagcatccctccccatgcaaccaccctatccctgccaagtttctgggcaccacagattggaaagtagcctcctgtaggtatttgcccatgttaagtggtggggtctctttctgtcttcccttcttggtctcacctgtctggtgtgacaagggaagcatgtgccaaccaaggctagacccttgtgagaccagagcagccccactttcggtaaagcaagcaacctctgcttacttgcccaacacaccctagcttccgtgttccttgccttgtgagttatcttcttgggtacaatttaacacagcgttcccacctccttataactaaaatagctagagggggctttgtgcctcaaaccccaaggagaccatcttggcaatctctgcctctgcaacagggcacttgctccctgggcaactcctttcccaggtcatcttctcccttgacatgcccatcagatttaatagtgtgcctatttggcagaaaaatggggtcccttggttgctgattcttaggaatgtgaggttctcccagccagagctctcagcactaaaagttctagtctctgcgtaatggccggcatatctttggcgtatctaaaatcctcttcagtttccagcagggtctttataagcttcttctgaaggtctcagacattcagccacggaactcaagtggaatttgtttggataacgtgactgatttcaaagcccggaccccttagacgtgcccatttggtgctgcaagtactgaccattactacaacatcttacagtcaacaaatttgacacattaaagatttatatcctttcttttgggttaggatcttctctcccctaaagcatctcagtttccagcatgcaatcatttccatcttatggaaatcagccatcccgctccgtgccagcatgctaccctgggaggcacatccaggcttgggaaacgggggtgtcctggatctcatgactccagcagcaccagctgctctctttcctcttccaagtagacttccgttccccccccacttgggtgtttttgtttgttttagcaattcagagctcaagataaagaccttaaagataactttgtgtgtctctccctttctaggtatttgcataggaatcagaggagttaatcttgcatatggctacccattctccccagaaatctcaccagtgtgctcactgtgagaagacgttcaaccggaaagaccacctgaaaaaccacctccagacccacgaccccaacaaaatggcctttgggtgtgaggagtgtgggaagaagtacaacaccatgcggaagagaagccccctagcggaaccaaggaaaagaagcaccagtgcgaccactgtgaaagatgcttctacacccggaaggatgtgcgacgccacctggtggtccacacaggatgcaaggacttcctgtgccagttctgtgcccagagatttgggcgcaaggatcacctcacccggcataccaagaagacccactcacaggagctgatgaaagagagcttgcagaccggagaccttctgagcaccttccacaccatctcgccttcattccaactgaaggctgctgccttgcctcctttccctttaggagcttctgcccagaacgggcttgcaagtagcttgccagctgaggtccatagcctcaccctcagtcccccagaacaagccgcccagcctatgcagccgctgccagagtccctggcctccctccacccctcggtatcccctggctctcctccgccaccccttcccaatcacaagtacaacaccacttctacctcatactccccacttgcaagcctgcccctcaaagcagatactaaaggtttttgcaatatcagtttgtttgaggacttgcctctgcaagagcctcagtcacctcaaaagctcaacccaggttttgatctggctaagggaaatgctggtaaagtaaacctgcccaaggagctgcctgcagatgctgtgaacctaacaatacctgcctctctggacctgtcccccctgttgggcttctggcagctgccccctcctgctacccaaaatacctttgggaatagcactcttgccctggggcctggggaatctttgccccacaggttaagctgtctggggcagcagcagcaagaacccccacttgccatgggcactgtgagcctgggccagctccccctgccccccatccctcatgtgttctcagctggcactggctctgccatcctgcctcatttccatcatgcattcagataattgatttttaaagtgtatttttcgtattctggaagatgttttaagaagcattttaaatgtcagttacaatatgagaaagatttggaaaacgagactgggactatggcttattcagtgatgactggcttgagatgataagagaattctcgaactgcatgtattgtgccaatctgtcctgagtgttcatgctttgtaccaaatttaatgaacgcgtgttctgtaatcaaactgcaaatattgtcataaccaacatccaaaatgacggctgctatatataagtgtttgtcatatggaatttaatcgtaagccatgatcataatgttaactaaataactttatgtggcactgcctagtaagggaactatggaaaggtttggatttctccaaatctgggagaattttcaaaataagaaaataacctttatatgatatactatgactaggctgtgtatttcttttcagggatttttctaccttcagggttggatgtagtttagttactattaccatagccaacctgtagttttacatatacattttcttgtggagcaatagagttctccattttacagaagcattttaaatgtagtttgaatattttccacaagatgctgcaatgtgagttatcacttcatttatcttaaagaaagactaaactggttgtcagttacatctgacagaaaaaaaaaaaaaatcactgtgtaaccaggttaagtggtaaaataatccaggcgtcagtcaaaggcattttgctgactttaatattgattatatttttaacaggaatttaagaaaatattactggaattaaaaatatatatatattaaacaagaattttctttgctctgtctagcttaaactactactcaagctgcttaagttcttaagtattgtttgtaatcaccaataaataagtgcatttgtaattcatcagtcattattagcttttattaaaagaagattacgttttacaatgtaactataatctcttgaatttggtatcttattaatgagttttaaagatgtaaaacctaaccttttttaaagctccattgtcttatgtttttagaggcttttccgtaaacatatatcttacatataataaacttttcaaatcttgc

SEQ ID NO: 22788 - DNA, 5705 bp, Homo sapiens
cgcggcaccgccccctccacgacccgagcgcccgctcgcgcggctcccacaatgcaccgcacaatggcccgaccgccgccactaccggggcctgagggggcctggcggagcccgagcgcggcccggcccgcagcgtggggccccgagcgcggtgaagagattgttttctgaaagctgcgttggaggctgtgacagagctgagagcctgtgtggagcggatggggaggctttctcaataacatggccctttgccattagccttgccatgaccacatttttcaccagcgtccccccctggattcaagatgcaaagcaggaggaggaagtgggctggaaactagttcccaggcctcggggccgggaggcggagagtcaagtgaagtgccaatgtgaaatttcgggaacacctttctcaaatggggagaagctgaggcctcacagcctcccgcaaccagagcagagaccatatagctgccctcagctgcactgtggcaaggcttttgcttccaaatacaagctgtataggcacatggccacccactcagcccagaaaccccaccagtgtatgtactgtgataagatgtttcaccgcaaggaccatctgcggaaccatctgcagacccatgatcctaacaaagaggccctccactgctctgagtgcggtaagaattacaatacgaagctgggctaccggcgccacctggccatgcatgctgccagcagcggtgacctcagctgcaaggtgtgcctgcagacctttgagagtacccaggccctgctagagcacctgaaggcccactcacgccgggtagcaggcggtgccaaggagaagaagcacccctgtgaccactgcgaccggcggttctatactcgtaaggatgtacggcggcacctagtggtgcacacaggccgtaaggacttcctgtgccagtactgtgcccagcggtttggccgtaaggaccacctgacgcgtcatgtcaagaagagccactcgcaggagctgctcaagatcaagacagagcccgtggacatgttaggcctactcagctgcagctccacagtcagtgtgaaggaagagctgagccctgtgctgtgcatggcctctcgggacgtaatggggaccaaggccttccctggcatgttgcccatgggcatgtatggtgcccacatccctaccatgcccagcacgggcgtgccacactccctggtgcacaacacgctgcccatgggtatgagctaccctctggaatcctcacctatctcttccccagctcagctccctccaaaataccagcttggatctacctcatacttgcccgacaaattgcccaaagtggaggtggatagttttctggcggagcttcctggaagcctgtctctctcatccgctgaaccccagcccgcctcacctcagccggcggcagctgcggccctcctagatgaagcactgcttgccaagagccccgccaacctctctgaggccctctgcgctgctaatgtggacttctcccacctactgggctttcttccactcaacctgcccccgtgtaacccacctggggccacaggaggcctggtcatgggctactcccaggctgaggcacagcccctgcttaccactttgcaagctcagcctcaagattccccaggagctgggggaccactgaactttgggcctctgcactccttgcctcctgtcttcacgtctggcctgagtagcaccaccctgcctcgtttccatcaagcattccagtagcccccacagaggccctcagctcagtttttggctctgttatggagccttagtacccaccccgtctgtgtcccccatgaaggcagctgagctttcagagctgggttcaaaaaaaaaaattccagtgtctgtatacaggagcacttggtttgggggttcaggctctaggatcgattccagaaggagccttgagccccaaccccgtgaaaagatctcataccgtaggacttcaggtattatttacttttatttttttgacctgaatcgggagccacacttggccctcttcctctccaaagcgccagaacctccttctctttggagaatggggaggcctcttggagacacagagggtttcaccttggatgacctctagagaaattgcccaagaagcccaccttctggtcccaacctgcagaccccacagcagtcagttggtcaggccctgctgtagaaggtcacttggctccattgcctgcttccaaccaatgggcaggagagaaggcctttatttctcgcccacccattcctcctgtaccagcacctccgttttcagtcagtgttgtccagcaacggtaccgtttacacagtcacctcagacacaccatttcacctcccttgccaagctgttagccttagagtgattgcagtgaacactgtttacacaccgtgaatccattcccatcagtccattccagttggcaccagcctgaaccatttggtacctggtgttaactggagtcctgtttacaaggtggagtcggggcttgctgacttctcttcatttgaggtcacatttttcccccgtggggaaataaactgactttggactgcttcagtctctgccatcttccatgactgcatttgttcctgcctgcctcggcggtatccacagaagacaggcaagaggattggagcagttttctcacaggtctgcaattctgtttttctccaagtacattatgaccccctcatccttctcttgaactggagaggggaagaaatgaaaggcatgcccacgtccgtcacctccccatcccctagtccccaccttgaacatcatgagctgttgttattagtcttggaagcagagtctgggttggtgtggatagcaaaggaggaagtctgagcccctcattggtcttcctcccacctgtcccttttccgggaagttgtggaattgttggaagaagagtttgcagaaggttaggaatgggtagatagctaagtcctaatctatgggtacattgttgtgtcccaaaccaaaattttccttatccacaatgtcccttctgtctcttccactttacagtggactcggccactgtgcataggcttctctgctctccatcaaatcacttccactttcctgtgcccccacccccgcctccagttttccgctagtatccggcaaggtttcttgcaacaaatgattagttcttttcttctgactcgtggggctccctgctgcagagagcacagcccttgcctggagcccaggaaccccatccttgcttcatctcagttcttcatgggcttcactcttcccactcacggaagggaggtagctcagggacctccactgtgggacccttgagacgcttccactctgattcagaaacacacttctacctctttactgttaactcttaacagatgcagtcagcagtttctgggcacttctctcagtaggtgcctcatgctgacttctccagtagggtttcaggacaaactaccaaggaattgcctcagcctcctaccagtcctccctcacccaccttctgtctaggttcacttggtttgtcatcaggaactgagcaggtccaggactcagctttctgcttcagcctaagccagtactccttgtttgaggtaaaagccttaaaatttagctccctagctcttgattagaagcaatttggagtaagtgtgttttgatttaggcagggtagcttgggatacctttttaaaaacaccagatattaaaatgtctggcaaggttagaatcagactagatgatttgcttctaaaaattagtttcagtgagtcccagggactaattaaggtttattttaaaaagtgtctaccttggtacgcagccacctcctgcatgctgtgcatgttattgggacttgtattataggtgatggtatgtgagaatccagttgggactcgctgttgccatcctctttgttgtatctggttttcatcactagactcagcaacccttctcaccttaactgccaccttccctacactctcagtttacagaggccactgggcctctggctgcagaatacaaagtcccgggctgttagaggagtcctttcctctctgcctgccctttcctgtccctccctcgaattctctctccccgtaagtgatgctggaaaagtcataggactggcaaagcaactgtttaaaccctttgtaaccggggccttgcccccacctcctgtcttttctccttgccttccccactcctgtgtcctcccatctatcctgtctttcctttcctcctctcagtgtcctcagcacccacaaggaattttcctatcactgtgaactttgctggtacagaggaataatatctgccttcacctttttttttttggaccatagctagccagtcatttcttaaacctcccttcctaaaatctggggggtcggggggaaagaaaaaaaaagccttagtggcctggttgttcaaaggataagaatagctttatcctgcactcagtacccgaactcacttcagtatgcttactgaggccatgagaacctgaggggcatctgcccaggacaggagccatggcatatgacaaagaccaatgagggaccaggaaaaaaagtgatgtcccctttccctgccacctccagcctctgccagcaatgagctgtccccctcccaccctacacagtagctggtcagggctgagtacagtcctgggggtaaggggatgacatgcccaggtgtcagctcaaaggatctctgcatcatcttgaggtgggaggcagggaaaggagcgccaatgaggttccctgcaacccccgccctccagcccaccgcccaaccttttacaaatggcattttcttaattgaaaatccgggaagcaggtgtgattacttttttgctcgtagatattgtcctaagttggaattctcccactgccctaaaactttccctagtagtcctttaaactcccccctccctttttggtagctgttttctccgtcctctctccacctgccctcttatctaggagctgtttgtaagcacgatttttttaacaggttatattgtacaggatcaatattttgctttttaacaaggatatttatgtaataagaaactttgccttaggcaggtgttggccagaaaagtccagattcctctgggatcccaccctggcctctcctggaactctgaacctgctgtggaaggaattggccatgaccttcacctctggagagtagggtctatggcgagggaaaagggtgttcaccatgataacctagtgcctccatagaggggtttggaaaaattccagtccgatttctttgtgtgtcagctgacttccttagctgattgttcccacttgcacctctccacctttggcactagaactcctgagacaccacttctcatgcttctccctccctaccagcggtcaaggctttggagccactcttttgtaactccagattatttaaagagaaaagtacaagacagaaatcttctagcactttgtaaacacagtgaataacctcttggagtatttttggctttatataaaacaaggtttttaattgtaaagtataagtgccattagaaaatgcacagggcatatctttgttaaagtagatttttcaatgttttacagaattacattttcaaaaaaaggtttttataatgaagttgtttattaaaaacttctgaatgatgtgttt

SEQ ID NO: 22789 - DNA, 1614 bp, Homo sapiens
ttgctccgcagggagagactgcccctggagtattctgcttttaataagcttcccaatcagctctcgagtgcaaagcgctctccctccctcgcccagccttcgtcctcctggcccgctcctctcatccctcccattctccatttcccttccgttccctccctgtcagggcgtaattgagtcaaaggcaggatcaggttccccgccttccagtccaaaaatcccgccaagagagccccagagcagaggaaaatccaaagtggagagaggggaagaaagagaccagtgagtcatccgtccagaaggcggggagagcagcagcggcccaagcaggagctgcagcgagccgggtacctggactcagcggtagcaacctcgccccttgcaacaaaggcagactgagcgccagagaggacgtttccaactcaaaaatgcaggctcaacagtaccagcagcagcgtcgaaaatttgcagctgccttcttggcattcattttcatactggcagctgtggatactgctgaagcagggaagaaagagaaaccagaaaaaaaagtgaagaagtctgactgtggagaatggcagtggagtgtgtgtgtgcccaccagtggagactgtgggctgggcacacgggagggcactcggactggagctgagtgcaagcaaaccatgaagacccagagatgtaagatcccctgcaactggaagaagcaatttggcgcggagtgcaaataccagttccaggcctggggagaatgtgacctgaacacagccctgaagaccagaactggaagtctgaagcgagccctgcacaatgccgaatgccagaagactgtcaccatctccaagccctgtggcaaactgaccaagcccaaacctcaagcagaatctaagaagaagaaaaaggaaggcaagaaacaggagaagatgctggattaaaagatgtcacctgtggaacataaaaaggacatcagcaaacaggatcagttaactattgcatttatatgtaccgtaggctttgtattcaaaaattatctatagctaagtacacaataagcaaaaacaaaaagaaaagaaaatttttgtagtagcgttttttaaatgtatactatagtaccagtaggggcttataataaaggactgtaatcttatttaggaagttgacttatagtacatgataaatgatagacaattgaggtaagttttttgaaattatgtgacattttacattaaattttttttacattttttgggcagcaatttaaatgttatgactatgtaaactacttctcttgttaggtaatttttttcacctagatttttttcccaattgagaaaaatatatactaaacaaaatagcaataaaacataatcactctatttgaagaaaatatcttgttttctgccaatagattttttaaaatgtagtcagcaaaatgggggtggggaagcagagcatgtcctagttcaatgttgactttttttttttttaaagaaaagcattaagacataaaattctttcactttggcagaagcatttgttttcttgatgaaattatttttccatctgaggaaaaaaatactaggaaaataaatcaaggtgatgctgaaaaaaaaa

SEQ ID NO: 22790 - DNA, 1673 bp, Homo sapiens
tccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttc

SEQ ID NO: 22791 - DNA, 1719 bp, Homo sapiens
atgatttgtgaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccct

SEQ ID NO: 22792 - DNA, 3351 bp, Homo sapiens
gcagagcttgcatcacatccgccgcctgggcgcccaattccggaaggtgctgcacagctgtggcggcgggtactgcgttagtgattagagtttcttccctgccggaggtgggatacacggtagcatcatggtcgaggaggtacagaaacattctgtacacacccttgtgttcaggtcgttgaagaggacccatgacatgtttgtagctgataatggaaaacctgtgcctttagatgaagagagtcacaaacgaaaaatggcaatcaagcttcgtaatgagtatggtcctgtgttgcatatgcctacttcaaaagaaaatcttaaagagaagggtcctcagaatgcaacggattcatatgttcataaacagtaccctgccaatcaaggacaagaagttgaatactttgtggcaggtacacatccatacccaccaggacctggggttgctttgacagcagatactaagatccagagaatgccaagtgaatcagctgcacagtccttagcggtggcattacctttgcagaccaaggctgatgcaaatcgtactgcccctagtggaagtgaataccgacatcctggggcttctgaccgtccacagcctacagcgatgaattcaattgtcatggagactggcaataccaagaactctgcactgatggctaaaaaagcccctacaatgccaaaaccccagtggcacccaccgtggaaactctacagggttatcagtgggcatcttggctgggttcgatgtattgctgtggaacctggaaatcagtggtttgttactggatctgctgacagaactataaagatctgggacttggctagtggcaaattaaaactgtcattgactgggcatattagtactgtgcggggcgtgatagtaagcacaaggagcccatatctgttctcttgtggagaagacaaacaagtgaaatgctgggatctcgaatacaataaggttatacggcattatcatggacatttaagtgcagtgtatggtttggatttgcacccgacaatcgatgtgttggtaacctgtagtcgagattcaactgcacggatttgggatgtgagaactaaagccagtgtacacacattatctggacatacaaatgcagttgctacagtgagatgtcaggctgcagaaccacaaattattacaggaagccatgatactacaattcgattatgggatctggtggctggaaaaacaagagtgacattaacaaatcacaaaaaatcagttagggctgtggttttacatccaagacattacacatttgcatctggttctccagataacataaagcagtggaaattccctgatggaagtttcattcaaaatctttccggtcataatgctattattaacacattgacggtaaattctgatggagtgcttgtatctggagctgacaatggcaccatgcatctttgggactggagaactggctacaattttcagagagttcacgcagctgtgcaacctgggtctttggacagtgaatcaggaatatttgcttgtgcttttgatcagtctgaaagtcgattactaacagctgaagctgataaaaccattaaagtatacagagaggatgacacagccacagaagaaactcatccagtcagctggaaaccagaaattatcaagagaaagagattttaatgaatgtggaattttttctctctctttttttttctttttaattaaaaaaaaaaaagcttggcgttcatgaggatatccagtcattttgtgctctggctgggaatataaaggagaaattcacttgcttcaatcattgctgcttcatattttacaataaactgtcccctgtcccctacccctgtgtttttatttctaaaacaatttgtgatactaggaagatgcagatatcaagtaaatgcaggtttattgaacataactattctagatgtaatattttgacagtcttattagaaaacccccttttttaaaaaaaatgtatgaaaccgataattaggacatttgaaggagcagtagtttttttttagtcctttaaaaaataacatctgtgactaataatttgagattaaaagatttgaagtcttaatttatgtatgtttattccaaaaacagtttttgagtgtatgttctacaaagttctgcactagatactgttcaggaaatagacaagtaagatgtgtctatcctctaagacttccagtttggtagcttagtatagaaattctgtaacagaggtgcaggtgaaatgctgggggaacagaagggataagaccatttatttttctcaggaaggattgtggaagacttcatagagtaagtggcattggagattaccttgaagtgaaggaagacaaagaaggaaaagagatgaggcataaagtgatgaaaccaggcacaagaaagtgtgcggtgtgttctgggacaaagaatgttctgctactgtcgaataatgggactaaagctggcttgttctggggaaagctcatataagtatggattttattcctcaactagtaggataccaatactggtattgaaacttggggaaaataactggagataccagtgcagctatttaaagctgtagcaagggctgcaatcttgcggagattttaaagagaagttttaaagtttctaatactgatgcctctttttggtaaatacaagttttataaatcctgccctgggatcctgattccccattaatcaagatttgtcagacttcaccttctataattagaaaacacagttataagaacagtcaattttttaaattttccaaattaaaaaattgcaccatgattttgaacaagcacttccaattacattacccatcttgtatgccataggtgggagtataattgtcacagcctttaggaatgtagttttctgggatttattgaaactttgaaccttttggcctactaagttcattcctaggaaactgcctaatgggaatgatctgacaagtgtacacaagcaaagtcattgcacctttgttctttaatacttaaaactagcccaaatgccctgtcagtaagggactggtttaatagatggtacctttatgcaatttgtttctaagtattcgttaagagagtgaggaatgtctggattattagggcaagatttctaaacttgggtaaaaaaaaaagttgtgcaagcatttttgtggacaacttgatgctctaaaatataagtaacaccacattactaacagtggctttgttaggaagcagaattatggaagaactttcatgggtggctttacatatttctataatgttttaattttctataagcatgtatttcgtaaacttaaataaagaaaaaagaacact

SEQ ID NO: 22793 - DNA, 9066 bp, Homo sapiens
atgccgctgccaccgcggagcctgcaggtgctcctgctgctgctgctgttgctgctgctgctgccgggcatgtgggctgaggcaggcttgcccagggcaggcgggggttcacagccccccttccgcaccttctcggccagcgactggggcctcacccacctagtggtgcatgagcagacaggcgaggtgtatgtgggcgcagtgaaccgcatctataagctgtcggggaacctgacactgctgcgggcccacgtcacgggccctgtggaggacaacgagaagtgctacccgccgcccagcgtgcagtcctgcccccacggcctgggcagtactgacaacgtcaacaagctgctgctgctggactatgccgctaaccgcctgctggcctgtggcagcgcctcccagggcatctgccagttcctgcgtctggacgatctcttcaaactgggtgagccacaccaccgtaaggagcactacctgtccagcgtgcaggaggcaggcagcatggcgggcgtgctcattgccgggccaccgggccagggccaggccaagctcttcgtgggcacacccatcgatggcaagtccgagtacttccccacactgtccagccgtcggctcatggccaacgaggaggatgccgacatgttcggcttcgtgtaccaggatgagtttgtgtcatcacagctcaagatcccttcggacacgctgtccaagttcccggcctttgacatctactatgtgtacagcttccgcagcgagcagtttgtctactacctcacgctgcagctagacacacagctgacctcgcctgatgccgccggcgagcacttcttcacgtccaagatcgtgcggctctgtgtggacgaccccaaattctactcgtacgttgagttccccattggctgcgagcaggcgggtgtggagtaccgcctggtgcaggatgcctacctgagccggcccggccgtgccctggcccaccagctgggcctggctgaggacgaggacgtgctgttcactgtgttcgcccagggccagaagaaccgcgtgaagccaccaaaggagtcagcactgtgcctgttcacgctcagggccatcaaggagaagattaaggagcgcatccagtcctgctaccgtggtgagggcaagctctccctgccgtggctgctcaacaaggagctgggctgcatcaactcgcccctgcagatcgatgacgacttctgcgggcaggacttcaaccagcccctggggggcacagtcaccattgaggggacgcccctgttcgtggacaaggatgatggcctgaccgccgtggctgcctatgactatcggggccgcactgtggtattcgccggcacgcgaagtggccgcatccgcaagatcctggtggacctctcaaaccccggtggccggcctgccctggcctacgagagcgtcgtggcccaggagggcagccccatcctgcgagacctcgtcctcagccccaaccaccagtacctctacgccatgaccgagaagcaggtgacgcgggtgcctgtggagagctgtgtgcagtacacgtcctgtgagctgtgtctggggtcacgggacccccactgtggctggtgtgtcctgcacagcatctgctcgcggcgggacgcctgtgagcgagcagacgagccccagcgctttgctgcggacctgctgcagtgtgtgcagctgactgtgcagccccgcaatgtgtctgtcaccatgtcccaggtcccacttgtgctgcaggcctggaacgtgcctgacctctcagctggcgtcaactgctccttcgaggacttcacggaatctgagagcgtcctggaggatggccggatccactgccgctcaccctccgcccgggaggtggcgcccatcacgcggggccagggagaccagcgggtggtgaaactctacctaaagtccaaggagacagggaagaagtttgcgtctgtggacttcgtcttctacaactgcagcgtccaccagtcctgcctgtcctgtgtcaacggctcctttccctgccactggtgcaaataccgccacgtgtgcacacacaacgtggctgactgcgccttcctggagggccgtgtcaacgtgtctgaggactgcccacagatcctgccctccacgcagatctacgtgccagtgggagtggtaaaacccatcaccctggccgcacggaacctgccacagccacagtcaggccagcgtggatatgagtgcctcttccacatcccgggcagcccggcccgtgtcaccgccctgcgcttcaacagctccagcctgcagtgccagaattcctcgtactcctacgaggggaacgatgtcagcgacctgccagtgaacctgtcagtcgtgtggaacggcaactttgtcattgacaacccacagaacatccaggcgcacctctacaagtgcccggccctgcgcgagagctgcggcctctgcctcaaggccgacccgcgcttcgagtgcggatggtgcgtggccgagcgccgctgctccctgcgacaccactgcgctgccgacacacctgcatcgtggatgcacgcgcgtcacggcagcagtcgctgcaccgaccccaagatcctcaagctgtcccccgagacgggcccgaggcagggcggcacgcggctcactatcacaggcgagaacctgggcctgcgattcgaagacgtgcgtctgggcgtgcgcgtgggcaaggtgctgtgcagccctgtggagagcgagtacatcagtgcggagcagatcgtctgtgagatcggggacgccagctccgtgcgtgcccatgacgccctggtggaggtgtgtgtgcgggactgctcaccacactaccgcgccctgtcacccaagcgcttcaccttcgtgacaccaaccttctaccgtgtgagcccctcccgtgggcctctgtcagggggcacctggattggcatcgagggaagccacctgaacgcaggcagtgatgtggctgtgtcggtcggtggccggccctgctccttctcctggaggaactcccgtgagatccggtgcctgacaccccccgggcagagccctggcagcgctcccatcatcatcaacatcaaccgcgcccagctcaccaaccctgaggtgaagtacaactacaccgaggaccccaccatcctgaggatcgaccccgagtggagcatcaacagcggtgggaccctcctgacggtcacaggcaccaacctggccactgtccgtgaaccccgaatccgggccaagtatggaggcattgagagggagaacggctgcctggtgtacaatgacaccaccatggtatgccgcgccccgtctgtggccaaccctgtgcgcagcccaccagagctgggggagcggccggatgagctgggcttcgtcatggacaacgtgcgctccctgcttgtgctcaactccacctccttcctctactaccctgaccccgtactggagccactcagccccactggcctgctggagctgaagcccagctccccactcatcctcaagggccggaacctcttgccacctgcacccggcaactcccgactcaactacacggtgctcatcggctccacaccctgtaccctcaccgtgtcggagacgcaactgctgtgcgaggcgcccaacctcactgggcagcacaaggtcacggtgcgggcaggtggcttcgagttctcgccagggacactgcaggtgtactcggacagcctgctgacgctgcctgccattgtgggcattggcggaggcgggggtctcctgctgctggtcatcgtggctgtgctcatcgcctacaagcgcaagtcacgagatgctgaccgcacactcaagcggctgcagctccagatggacaacctggagtcccgcgtggccctcgaatgcaaggaagcctttgcagagctgcagacagacatccacgagctgaccaatgacctggacggtgccggcatccccttccttgactaccggacatatgccatgcgggtgctctttcctgggatcgaggaccaccctgtgctcaaggagatggaggtgcaggccaatgtggagaagtcgctgacactgttcgggcagctgctgaccaagaagcacttcctgctgaccttcatccgcacgctggaggcacagcgcagcttctccatgcgcgaccgcgggaatgtggcctcgctcatcatgacggccctgcagggcgagatggaatacgccacaggcgtgctcaagcagctgctttccgacctcatcgagaagaacctggagagcaagaaccaccccaagctgctactgcgccggactgagtcggtggcagagaagatgctaactaactggttcaccttcctcttgtataagttcctcaaggagtgcgctggggagccgctgttcatgctgtactgcgccatcaagcagcagatggagaagggccccattgacgccatcacgggtgaggcacgctactccctgagtgaggacaagctcatccggcagcagattgactacaagacactgaccctgaactgtgtgaaccctgagaatgagaatgcacctgaggtgccggtgaaggggctggactgtgacacggtcacccaggccaaggagaagctgctggacgctgcctacaagggcgtgccctactcccagcggcccaaggccgcggacatggacctggagtggcgccagggccgcatggcgcgcatcatcctgcaggacgaggacgtcaccaccaagattgacaacgattggaagaggctgaacacactggctcactaccaggtgacagacgggtcctcggtggcactggtgcccaagcagacgtccgcctacaacatctccaactcctccaccttcaccaagtccctcagcagatacgagagcatgctgcgcacggccagcagccccgacagcctgcgctcgcgcacgcccatgatcacgcccgacctggagagcggcaccaagctgtggcacctggtgaagaaccacgaccacctggaccagcgtgagggtgaccgcggcagcaagatggtctcggagatctacttgacacggctactggccaccaagggcacactgcagaagtttgtggacgacctgtttgagaccatcttcagcacggcacaccggggctcagccctgccgctggccatcaagtacatgttcgacttcctggatgagcaggccgacaagcaccagatccacgatgctgacgtgcgccacacctggaagagcaactgcctgcccctgcgcttctgggtgaacgtgatcaagaacccacagtttgtgttcgacattcacaagaacagcatcacggacgcctgcttgtcggtggtggcccagaccttcatggactcctgctccacctctgagcacaagctgggcaaggactcaccctccaacaagctgctctacgccaaggacatccccaactacaagagctgggtggagaggtactatgcagacatcgccaagatgccagccatcagcgaccaggacatgagtgcgtatctggctgagcagtcccgcctgcacctgagccagttcaacagcatgagcgccttgcacgagatctactcctacatcaccaagtacaaggatgagatcctggcagccctggagaaggatgagcaggcgcggcggcagcggctgcggagcaagctggagcaggtggtggacacgatggccctgagcagctgagccccagctgtgatcatccagcatgatgcagcgtgaggacagctgagcagggaccgggacagccctcaccgcatgcgtgtggagtgtccggtggtgctcgggccgccgcagtgcagcgactgcccggccctccctcccctgcctcacccggtcgggtcccggctcttcctgtgtggaggtgatggtacctgccacaccacagctgcgcacacagctgcttgctcaggggccgggacagcactgggtgctcaggctggccaaggaccttcattgcctggcaagagctgcccagtggccttcatgggagaagggctgacctctgaggggctgaggggtgaggccagggccctccagggggaggggtagccagcttgggctgtccccttgagaccaggacaagaggctgggggtgtcagcattcccagctttccaagctgcccccaggcggcagagtctgagggtcccggggcccggttggcagctggagaaagaggcaaaaagcccgtagccgggcaagaggagctcaagtcggtctgggcccgttgccaccgactcccacctccagcacccatgcccgctgcaccgctgccatcctcagattcaccgcgtgctctgcgcggccgaggccggagcaccacatccacctcgccccagagaggctctgctccctcctatggaggggctgtgggccaggctgctcagactcctgggtggcttccagacggaccgggcagcccctctccgtcctcagggctgtgcctctgggagccactgggccaggggccccgggtcgcagagagcacgttcccgttatttattcccctccgcgtcctacacaggctgccctggcagctgtcttcaagggtaggctgagctccccaccctggagcccctgagggcggcccctgagcactcctctctctccactctctctgtccctgccccagcggcttccagtgtggcatctcagcagtgtcctggcccctccagagcagtgggacatctggggactgtttttgtgtttaggggaaaaaattctgctgcactctgcttgggccttgaggtctgtggcagggctcctctggcccgcagtggcctggatctatctgggccatgagtgacgggcagtgaccagagggactggaggccagcggtgtccacccttgccctcagcaagagagaatgcattcttaaaagaaagctgtacatgtatatatatgcatatatatatatgtggctctagcctcaggctccagccccagtggggtactgtacagttaactgaagaagaattttaaagacgatttgaacaagaaaatgaaggcagtgggaaagcaatgccaaatggttgtggagaaagtggccggagcctccctggagtggagcagccctgaagcctgtgccccccgacctgcgggccgctgttttggtttgacatgacaaggaaaggacttcctgctgaccctgagagcctctggggtgccgcggcaccacggggcatgcatgattgtgctagcgtttagtctgagttgatctttttaaaactgcaagtgttgaatactagaggttgttagacccttttttatgttttttaattaatcagtcacttgtaaaagcaaacaagcggtccatccccttttcaaggtcacttttttgatggtaccgaagatcccatggacattaagggacagctaactgtggccagactcagccccatgtccttggccaggcccaaggagaggactcggccccatggggtgtgccagtcttgcagtccgccccagctgagtagcgtgagccagatgacgccacagagacccgcctcttccctgaacgcgggtcggtgtggagtcagtgactgctgactcagggagctccttggccccgtgggcactgtgccagggctggggccttctgctgctgccacacccagctcaggcctgggccagcccctgcccccagcccactgagggggtgggcttactccctgggcagtcttgggggccagagctgaggccagtccatattacagtggctgggctgtttttttcagtagcccctagcattggctgggattcctgttcctgggtgcgcctccacctcccttctgatgtttcctggctatggtggggtgggaacctcagtttcccccaaagtcttccctggatgctggcttcaggttgaagtccctggttcttccagttcctcacgggttaggtaggggctcctgcatcaccttcagaatccagttccaacccccactctccttaggccttgtgctctgctctgccctgccaggctgcccttgtccatgtgagtagcatgggcgggtggtggggacggcagtggtgatgaagggggtgcaccacaggcctcatgaagcagttcccacatgggcgtgtggctggggcgtggccaccacagagcacatggctgtgtctaggcgcaagcactttagcagtatctgtttacatgcgcaaggatcaagccgactacctgtgctgtctactgggacagcagtctccgagctactccgtacctccctctgccaggtcgtggagttaggccccagtccctacttgtcactggttcccactgtgctcctaactgtgcagcacctgggagctctggcctggggctggaggccctggtaggagctgcagttggaggccgttctgtgcccagcagcggtgagcggctcccatgggccctgtgtctgcagggagccagggctgcggcacatgtgctgtgaaactggcacccacctggcgtgctgctgccgccacttgcttcctgcagcacctcctaccctgctccgtgtcctccctctccccgcgcctggctcaggagtgctggaaaagctcacgcctcggcctgggagcctggcctcttgatatacctcgagcttcccctgtgctccccagccccaggaccactggccccttggcctgaggggctgggggccccacgacctgcagcgtcgagtccgggagagagcccggagcggcgtgccatctcggctcggccttgctgagagcctccgccctggctttctccctgtctggattcagtggctcacgttggtgctacacagctagaatagatatatttagagagagagatatttttaagacaaagcccacaattagctgtcctttaacaccgcagaaccccctcccagaagaagagcgatccctcggacggtccgggcgggcaccctcagccgggctctttgcagaagcagcaccgctgactgtgggcccggccctcagatgtgtacatatacggctatttcctattttactgttcttcagatttagtacttgtaaataaacacacacattaaggagagattaaacatttttgctaaaagct

SEQ ID NO: 22794 - DNA, 9066 bp, Homo sapiens; identical to SEQ ID NO: 22793

SEQ ID NO: 22795 - DNA, 11444 bp, Homo sapiens
cgccgccgccgccgccaccgcgggagccagagctgccgggaggagcggcatccgcgccagactggagcgggagggcggcggagggcagttgctgggaatttttcagccgagagggcgagcgatccggagagagaccccgagagcttgggagcggtagggcgtgcgagcgccgcagccagcggagcaaacctcgaaatagatctggaaagccaggctcccggaggaaatgggactgtgaacgaaccggagagcaagaagggaaggaagcgccgggattgctgatgtcagaggagcccggaaagtcgcgctggaaaaatctgaagacagccggggctctgcttcttcctcaggagagacaccgccggccgcccccacacgccccctcggcgcctccgggtgccccctgagagccggcgacagcgcccagccgggctgctgcggggcgacggaggactgaggggcgcgcggagcggagaccgaggagcgacttcaggaatacagataagtgtctggtggcttgacgtggattttaatgaatttggactccatgtggatttggtcgtctccctgattccgagctgcgggcagggagaggggcctcgcgccgccctcagcagccggcggcggccgaggtagaccgagcggggacggaaggacagaccgacgtcgccgagctggaatcatgtgagggccaaccggggaaggtggagcagatgagcacacacaggagccgtctcctcaccgccgcccctctcagcatggaacagaggcggccctggccccgggccctggaggtggacagccgctctgtggtcctgctctcagtggtctgggtgctgctggcccccccagcagccggcatgcctcagttcagcaccttccactctgagaatcgtgactggaccttcaaccacttgaccgtccaccaagggacgggggccgtctatgtgggggccatcaaccgggtctataagctgacaggcaacctgaccatccaggtggctcataagacagggccagaagaggacaacaagtcttgttacccgcccctcatcgtgcagccctgcagcgaagtgctcaccctcaccaacaatgtcaacaagctgctcatcattgactactctgagaaccgcctgctggcctgtgggagcctctaccagggggtctgcaagctgctgcggctggatgacctcttcatcctggtggagccatcccacaagaaggagcactacctgtccagtgtcaacaagacgggcaccatgtacggggtgattgtgcgctctgagggtgaggatggcaagctcttcatcggcacggctgtggatgggaagcaggattacttcccgaccctgtccagccggaagctgccccgagaccctgagtcctcagccatgctcgactatgagctacacagcgattttgtctcctctctcatcaagatcccttcagacaccctggccctggtctcccactttgacatcttctacatctacggctttgctagtgggggctttgtctactttctcactgtccagcccgagacccctgagggtgtggccatcaactccgctggagacctcttctacacctcacgcatcgtgcggctctgcaaggatgaccccaagttccactcatacgtgtccctgcccttcggctgcacccgggccggggtggaataccgcctcctgcaggctgcttacctggccaagcctggggactcactggcccaggccttcaatatcaccagccaggacgatgtactctttgccatcttctccaaagggcagaagcagtatcaccacccgcccgatgactctgccctgtgtgccttccctatccgggccatcaacttgcagatcaaggagcgcctgcagtcctgctaccagggcgagggcaacctggagctcaactggctgctggggaaggacgtccagtgcaccaaggcgcctgtccccatcgatgataacttctgtggactggacatcaaccagcccctgggaggctcaactccagtggagggcctgaccctgtacaccaccagcagggaccgcatgacctctgtggcctcctacgtttacaacggctacagcgtggtttttgtggggactaagagtggcaagctgaaaaagattcgggccgacggtcccccccatggtggggtccagtacgagatggtctctgtgctcaaggacggaagccccatcctccgggacatggccttctccattgatcagcgctacctgtacgtcatgtctgagagacaggtcaccagggtccccgtggagtcatgtgagcagtatacgacttgtggggagtgcctgagctctggggaccctcactgtggctggtgtgccctgcacaacatgtgctcccgcagggacaaatgccaacaggcctgggaacctaatcgatttgctgccagcatcagccagtgtgtgagccttgcagtgcatcccagcagcatctcagtatctgagcacagccggttgcttagcctggtagtgagtgatgctcctgatctatctgcgggtatcgcctgtgcctttgggaacctgacagaggtggaggggcaggtgtccgggagccaggtcatctgcatctcacctgggcccaaggatgtccctgtcatcccgctggatcaagactggtttgggctggagctacagctgaggtccaaggagacagggaagatatttgtcagcaccgagttcaagttttacaactgcagtgcccaccaactgtgcctgtcctgtgtcaacagcgccttccgctgccattggtgcaagtaccgcaacctctgcactcatgaccccaccacctgctccttccaggagggccggatcaatatttcagaggactgtccccagctggtgcccacagaggagatcttgattccagtcggggaggtaaagccaatcacccttaaggcgcgaaatctgccccagccgcagtccggccagcgaggctatgagtgtgtcctcaacatacaaggagccatccaccgggtccccgctctgcgcttcaacagctccagcgttcagtgtcagaacagctcgtaccagtatgatggcatggacatcagcaatctggccgtggatttcgctgtggtgtggaacggcaatttcatcattgacaaccctcaggacctgaaagtccatctctacaagtgtgcagcccagcgggagagctgcggcctctgcctcaaggccgaccggaagtttgagtgtggctggtgcagcggcgagcgcaggtgcaccctccaccagcactgtaccagcccttccagcccctggctcgactggtccagccacaatgtcaagtgctccaaccctcaaatcaccgagattttgacggtgtctggaccgccggaaggagggacgcgagtgaccatccatggcgtgaacctgggtctggacttctccgagatcgcccaccatgtgcaggtggctggggtgccctgcacgcccctcccaggggaatacatcatcgctgagcagattgtctgtgagatgggccatgccctcgtgggaaccacctccgggccagtacgcctgtgtattggcgagtgtaagccagagttcatgacgaagtcccatcagcagtacaccttcgtgaacccttctgtgctgtcactcaacccaatccgaggtcccgagtcaggaggcactatggtgaccattaccggccattaccttggggctgggagcagcgtggcagtctacctgggcaaccagacctgcgagttctacgggaggtcaatgagtgagatcgtgtgtgtctcacccccatcatccaatggccttggcccggtccctgtttctgtgagtgtcgaccgagcccatgtggatagcaacctgcagtttgagtacatagatgaccctcgggtccagcgcatcgagccagagtggagcattgccagtggccacacacccctgaccatcacaggcttcaacctggatgtcattcaggagccaaggatccgagtcaaattcaatggcaaagaatctgtcaatgtgtgtaaagttgtgaacacaaccaccctcacctgcctggcaccctctctgaccacggactaccgccctggcctggacactgtggaacgcccagatgagtttggatttgtctttaacaatgtccaatccttgctaatttacaacgacaccaagtttatctactaccccaacccgacctttgaactgcttagccctactggagtcttggatcaaaagccaggatcgcccatcattctgaagggcaaaaacctctgccctcctgcctctggaggggccaaactcaactacactgtgctcatcggagagaccccttgtgctgtcaccgtatctgagacccagcttctctgcgagcctcccaacctcaccgggcagcacaaggtcatggttcacgtgggcgggatggtgttctcgcctggctcggtgagtgtcatctcagacagcttgctgaccctgccagccatcgtcagcatcgcggccggcggcagcctcctcctcatcatcgtcatcatcgtcctcattgcctacaagcgcaagtctcgagaaaatgacctcactctcaagcggctgcaaatgcagatggacaatctggagtcccgtgtggccttggagtgcaaggaagcttttgctgagctccagacggatatcaatgagttgaccagtgacctggaccgctcaggaatcccttacctggactatcgtacctacgctatgcgagtcctgttcccgggcatcgaggaccaccccgtcctgcgggagctggaggtacaaggaaacgggcagcagcacgtggagaaggccctgaagctctttgcccagctcatcaacaacaaggtgttcctgctgaccttcatccgcaccctggagctgcagcgcagtttctccatgcgcgaccggggcaacgtggcttcgctcatcatgaccggcctgcagggccgcctggaatatgccactgatgtcctcaagcagctgctctctgacctcatcgataagaacctggagaacaagaaccaccccaagctgctactccggaggacagagtctgtggctgaaaagatgctgaccaattggttcgccttcctcctgcacaagttcctaaaggagtgcgcaggggagccactcttcatgctatactgtgccatcaagcagcagatggagaagggccccattgatgccatcacgggcgaggcccgctactccctgagcgaggacaagctcatccggcagcagatcgagtacaagaccctgatcctgaactgcgtcaaccctgacaacgagaacagtccagagatcccagtgaaggtgttaaactgtgacaccatcacacaggtcaaggagaagattcttgatgccgtgtataagaatgtgccctattcccagcggccgagggcagtggacatggacttggagtggcgccaaggccggatcgcccgggtcgtgctgcaagatgaggacatcaccaccaagattgagggtgactggaagcggctcaacacactgatgcattatcaggtgtcagacaggtcggtggtggctctggtccccaaacagacctcctcctacaacatccctgcctctgccagcatctcccggacgtccatcagcagatacgactcctccttcaggtatacgggcagccccgacagcctgcggtcccgggccccgatgatcaccccagacctggaaagtggggtcaaggtgtggcatctggtgaagaaccatgaccacggtgaccagaaggagggtgaccggggcagcaagatggtgtccgagatctacctgacccggctactggccaccaagggcaccctgcagaagtttgtggacgacttgtttgagaccttgttcagcactgtgcaccggggcagcgctctccccctggccatcaagtacatgtttgatttcctagatgagcaggcagacaggcacagcatccatgacacagatgtgcggcacacctggaaaagcaactgcctccctctgcgcttctgggtgaacgtgattaagaacccccagttcgtgtttgacatccacaagggcagcatcacggacgcctgcctctctgtggtggcccagaccttcatggactcttgttcaacgtcagagcaccggctgggcaaggactccccctccaacaagctgctctatgccaaggacatccccagctacaagagctgggtggagagatactacgcagacatcgccaagctcccagccatcagtgaccaggacatgaatgcctacctcgccgagcagtcccgcctgcacgccgtggagttcaacatgctgagtgccctcaatgagatctactcctatgtcagcaagtatagtgaggagctcatcggggccctagagcaggatgagcaggcacggcggcagcggctggcttataaggtggagcagctcattaatgccatgtccattgagagctgagaggaggagcctcgcattcctgggaagagggacctgtccaagctgtcacactgggagtctcagatggaaggacaagtgatggggatcaggccccagagcttgctgtcccctgagaccccatcctggggagaggggaggactcctctccctacgccagccaagtttcgtcatagccagttccagctgggagagacagtgggcgtcgtccatcctcagtgagaacaccagagaacccggggccgggagaaggtggttcttcaagccgagaggcacgagctggggacagttctgcctctgtgactgctgctttgcatgaaaactcatttgatgtatattggggaaataatgagaactttatttaatttttttaagaaaaagggaaaaaaacagaaataaaacaaaaagccgccctgttaatcccgtccaacttttgtttaattctgatttctgtctcccttccatcttttctcccattcctccttctttatataatgcctatttccaaatgccagagaaagcagagatgctgagagacattggagagaaaatgactgtctccttttccttgaaattaaaaaaaaaaaaaaaaagagaaagaggagaagaagaatgatgagcacaagtatgcaccaaacacttcgcaaaaacagaggccagtaaaacctggaattatcccggcagccagaggagtatggaacttccagaactttgcacaaattgcaaagccatcaagagctcaccctggctgactggaaactgagctttatctaccacacacctgtatattctcatcttttgagaggagatgtgtacctagatagtaccaatgctttttgctactgttttttgttttgttttatttaatcctaaacctcaacaaatgaggagctggtctttgatatgtttcctttcaatttccctaaagttactatgagaagtggggtgaggtgggcctctcccagaccagacacctggcagccctgcctcatatcaatccctgtcataaaccaggcaccctggggaaacggcctggaggtgtgtgggccaggcctccacgaggttccatttgaaagttgatttggagacataggtgtttgactttggagttcactccaatcatccagtggtccctggcaattaaaaagaaaacaaaaatcaaacactgtttacagcaagcaatacttgaagagcataggttacagaagctgcagtatttattattatgctttctttctttcattctctcgtgcctggagaggggagaccacccttcgctcatatacggaagctcctgaccatctgggcctacagcacttcctcagtagaaatgactgtggcatgcccacgttactaccttctgcctctctttctgcctctcacggacttgtgagtgtgaaggacaagtggatgacttctcactggactttccttctctgtctcttctgatgatgcctaaaactatggataaccaattctcctgagtgtagattccaaacaaagagaccaaagctccatgcccaggtccaaaggccccatagaagccagtgggagtcatcgagaggaaaggcgctctgtgagtgtcaggaccttggtggccaggatagccatcagagtgtccaggcctcccacattaccttggatccgagcagccagctccaactgttctgcaagcagcactggagtcagggggtaggaggacaagtggaagcaaaggtgtgggactggggaagacaaagaggaacaagctgcccttcctcacttttcaaagggtcaggaatcctaggctatgatgctgggaagctagaccagctcctccaagagagactagaccagggtcattttctctgttattaactctgggctccagcttctccgtgccctgctttacctccaagtggttccaatttccaaaggccctgctgaccacatgtgattcccaggagagggctgggggaggggagcgcagaggtctggcttccatccttggcgtgtagctttggatcgctgtctaaccacacagcagacgttgcccggtctccccagctctagtttcttgcctgaatgcggctgacaaatgggaagagaaaagcattcagcaaaatactcaggaaacttgctgttttcattataattcacaaccagccatgccaaggccactttcttttgaaaatccacttctttaaagtttctcaggccctattagtagcctgaaggaaatactaatgactggccttccgcactaagccaaagtgtttgctcttcatagcactcaaagcttatcagcgcagagcccataatttatggagataaaaggaaaggagatataggtaagaagagtgtgaccaggagaccttatgctacctgtaaaaaagttcagcccaccccatctaacttctgagctctgtttgggtgaagattttctggccgcatggctgctcagactggcatccaggctttgctccaccaagaagttaaaggcagtcggacatctcagtagcatctctaccagcccttaactcaatgcatctacctggcatctcccagcagttacttttggagacgattcactgcccctggggcgtttccttgaaggtttgtggagagcgtggagaatgatggggcaatggccaattggagggtggagagtgaagagccggagctggctgtgagtggtttggccacatttctcaggattccatgagagacttggggaacttgggctgacaaaggaagtagcctggggcatccttaaggaaggaattaagaaaagggaaaaagctggactcaagccacgccatgagggtgaaaggttataaggccctgccccctttccagctgcccacctgttcctcctccacacctcttcgctttgggccaccaagaaccaatgaagtccacaccctttggatgagaaaaagagggagttggttggcctctcttctccctgttatccaatttgaggatattttgaccttgggtaaggatgaagtgttaaagccacagctcctctccacaagaagccattcatcttgggggaggcagagagggaagtctctctccaaagtctatccagcttcgcttcgtttcattgatctgcacaagagacaatgctctggaaaaggaagaggaccccagaagggtgcttggcaagacagaggatgctaatgggcaatggagagcactccctccagctggcccctgctgctgcctcccgtcctctgcatggggtcaggtgcttctgtgcttgctgtcctacctctctccacagcagggctctcaaaaccattttgatcccccattggcagagggttcccctctttacagagttcagtcattaaaagcatggatcagctgttaatctcattggaggagggaactgtttcctgcattcattcatctgggaaccttcttgagtagccactgtctgccagccactgctctagagatgggaaaacagcacggaacaaaaccaaggtctttcttccagcgaatttatatccttcaggaagctggttcctgccaccaacttagcaggcaacagttctcctcccctagtggcacagggtaccagttttgtaggaaaagtggtccagcaaaggaagaaagcagaccaacccagctgccttaccttattctggggccattcccccagcgatgagagctgctcttgtttctactgccaccatctcttctggctgcacttcacctgctgcttgagcttctgaccttccttcagttccaccaaatgaggacaggaaatagcagtcaagacccctggccctgctgagcgtgaaacagaagcaatggatgagtgctggacgaagaatggcctgggcagaacaaatagggagcatttgaaagcttctggctgataaatctccaggtgcatcccggttgccacgcctgcccccattaacctgctcctggtaaatactgatccagcagctgctccaggagaggccgtctttttttcccagccacgctgtgtcttgcatgagactcctggggcctgggcacagagagaaaagaattgagactcaggaggctcagtgggtgagaaaatgcaaagtggcttcacagacacagggctgtgggagcagatcgacggggaacttgggagatgaacttcagggccttccgacgccttgtctcaggaacatgctttgagaaaaatggtagcatcctttccataactcagtctctcttccctagtttccctgaagtgtgacgttttagtatctggagctcagtgatccccatgaatgagggataaagtttcactcttggtattttctaactagtgctagggaaagtcctgagacacgatcacagccactgcttggcatacagggcctccacccaataagcaaactggagattcctcagcctctcgtggacacccacatctcattcttctcacagcagagaagctctcccttcagcctgagctgtcttctttctgctgcagtgcagcctgctccctcctaccctggcctcaaggaaggtaggaaacatcttctgcatttcaaagtcctcactttgacttatttggccttcatcttggcatggaaggtggcaggcagaatggaaatactccccccaaacagaacagatattcttgcgtgtgtaagggcagaagggacaagctctctatcccatgagactaggggccggagcccacctgcctttccccacaacttttcctgctcaaacccactcctcttgacacactggaatctgtattatatatatttttaagaaaatacaatgatggttgtctggttttgttgtttttacaggtgttgtggaataaaaactgtaagaaaattaagtatttaaaatgttccaataaagtggggttttttgttattctaatatattattgtgtacctattgtaaatatgaaacactcctattttgcaagctgaggacacaatttgtactgttgttatatataaataaagtttactgaattaaaaaaaccttaaatctttaaataaa

SEQ ID NO: 22796 - DNA, 13061 bp, Homo sapiens
tgcgttcggggctggggctggaggaggcagccacacgcgcgcacacgcacacgttcagaggagggcgagaggcagcggcataggctccatctgcagtgtcaatgcggcgctcccgctgaaggagggaaacgcggcgcgtccagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagatccgggtggatggacccaggggcaacgccctccagtatgagacggtgcaggtggtggaccccggcccagtcctccgggatatggccttctccaaggaccacgagcaactctacatcatgtcagagaggcagctcaccagagtccctgtggagtcctgtggtcagtatcagagctgcggcgagtgccttggctcaggcgacccccactgtggctggtgtgtgctgcacaacacttgcacccggaaggagcggtgtgagcggtccaaggagccccgcaggtttgcctcggagatgaagcagtgtgtccggctgacggtccatcccaacaatatctccgtctctcagtacaacgtgctgctggtcctggagacgtacaatgtcccggagctgtcagctggcgtcaactgcacctttgaggacctgtcagagatggatgggctggtcgtgggcaatcagatccagtgctactcccctgcagccaaggaggtgccccggatcatcacagagaatggggaccaccatgtcgtacagcttcagctcaaatcaaaggagaccggcatgaccttcgccagcaccagctttgtcttctacaattgcagcgtccacaattcgtgcctgtcctgcgtggagagtccataccgctgccactggtgtaaataccggcatgtctgcacccatgaccccaagacctgctccttccaggaaggccgagtgaagctgcccgaggactgcccccagctgctgcgagtggacaagatcctggtgcccgtggaggtgatcaagcctatcacgctgaaggccaagaacctcccccagccccagtctgggcagcgtggctacgaatgcatcctcaacattcagggcagcgagcagcgagtgcccgccctgcgcttcaacagctccagcgtacagtgccagaacacctcttattcctatgaagggatggagatcaacaacctgcccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatgacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaagcctttgccgagctgcagacggacatccatgagctgaccagtgacctggatggagccgggattccgttcctggactatagaacttacaccatgcgggtgctgttcccaggaattgaagaccaccctgtcctccgggaccttgaggtcccgggctaccggcaggagcgtgtggagaaaggcctgaagctcttcgcccagctcatcaacaacaaggtgttcctgctgtccttcatccgcacgcttgagtcccagcgtagcttctccatgcgcgaccgtggcaacgtggcctcactcatcatgaccgtgctgcagagcaagctggagtacgccactgatgtgctgaagcagctgctggccgacctcattgacaagaacctggagagcaagaaccaccctaagctgctgctcaggaggactgagtcagtggctgagaagatgctgaccaattggtttactttcctcctctacaagttcctcaaggagtgtgctggggagcccctcttctccctgttctgtgccatcaagcagcagatggagaagggccccattgacgccatcacgggcgaggcccgctactccttgagcgaggacaagctcatccgccagcagattgactacaaaaccctggtcctgagctgtgtcagcccagacaatgccaacagccccgaggtcccagtaaagatcctcaactgtgacaccatcactcaggtcaaggagaagattctggatgccatcttcaagaatgtgccttgctcccaccggcccaaagctgcagatatggatctggagtggcgacaaggaagtggggcaaggatgatcttgcaggatgaagacatcaccaccaagattgagaatgattggaagcgactgaacacactggcccactaccaggtgccagatggttccgtggtggcattagtgtccaagcaggtgacagcctataacgcagtgaacaactccaccgtctccaggacctcagcaagtaaatatgaaaacatgatccggtacacgggcagccccgacagcctccgctcacggacacctatgatcactcctgacctggagagtggagtcaagatgtggcacctagtgaagaaccacgagcacggagaccagaaggagggggaccgggggagcaagatggtgtctgaaatctacctgacccgactcctggccactaagggcacactgcagaagtttgtggatgacctctttgagaccatcttcagcacggcacaccgtggctctgccctgcccctggccatcaagtacatgtttgacttcctggatgagcaggctgataaacatggcattcatgacccgcacgtccgccatacctggaagagcaattgcctgcccctgaggttttgggtcaacatgatcaagaacccgcagtttgtgtttgacatccataagaacagcatcacagacgcctgcctctctgtggtggctcagaccttcatggactcttgctccacgtcagagcaccggctgggcaaggactcgccctccaacaagctgctgtatgccaaggacatccccagctacaagaattgggtggagaggtattactcagacatagggaagatgccagccatcagcgaccaagacatgaacgcatacctggctgagcagtcccggatgcacatgaatgagttcaacaccatgagtgcactctcagagatcttctcctatgtgggcaaatacagcgaggagatccttggacctctggaccacgatgaccagtgtgggaagcagaaactggcctacaaactagaacaagtcataaccctcatgagcttagacagctgagaaccgtccttccagggccgccctggagggggacacaccaagccgtgcctcagtctagattatcatctttaccaagtgcaagttccgactggcatcagcagcatcccctgagcagcgctgtttctctctctttctctctgcctctttccgtttctccctccttcctggatctcttctcttccagttgctctgccaacacgattggaccaagccactgaccctcagttagtccaagaatggccaggcccatggcaagggagctgaccagaagatgtcagagaggcctctgtctcccaggtgctcctgaccctgtgcatgtcagcagcagggtgcaaataacgaatgaggagccagggacaggggacatttctgtgctgctacttcaccttccactttggcagcccctgctttggtctgagccttggcctagggaagaggcaaggaaggacttcagtattatctttactgggaagacatcacctggctctcccttcccacagttccatctccagtggttcagccagtggtctgatcgctttgcagctgtgagaagaaaggctacacctcctgcatgtggctggagcagggcatgtgtgggcagctgggaggtgctccttgaggctccttctcccccactgggctggtgtccagaggcttcctgtccttttccaggtctccagagggacctgcctgccctgcctgctcccccgccagtagaaagccaggcaggagaaagaatagcaattacattccaccatggagatgctcctgaccttttcatctgaatcctagtagcagaaatgtaacacagggggagaaaaggaaagagagttgcatctaccctggaagcagaatttgttttccatttaccctcaaattcaaatgagtcacaatcatagtcataggtctagtccactaccagagccctgagtgctgtcaagagaaagcatctatctccaccctcctttgtcaaccttcatcaagggtcaacgtgaaatgcagagtgcatctaggagattctacctccagccatctccatggctccatccccatcatccttcctgagaactccatagacggctggggccaacagcctagtccctgttccctctgcagaatccggtgccattgctatgcagatgactttgtcactgggctgtccagacctctttgggaatgatttcatcaacatctcagctgtctctcatcattctccttcctcatctcttcagcagtcatccttgaaagaaacagacttaagcaaagcctcacggagacagcccaaaatgccagccaacctcagcctccagcttgtcagatctgggagggacaaagagtcgagctgatgggcctggctggaattaagaagagggacatacaaatgaccttggccttggcatccatctccccatctgttcttacatctacagatgcacgattttagccaggcaggcaaatgtgtgcctagaaattgatactaggtaagcagaggctatggggagagatggtctaatggagggttctaggaacctttcatcctaaggagaccttaggtgctgtctggtgcagtctcccatcctaagcaggagtctctgttggcacctctgctctggagttgttcaccactatgggagacaaggagaaacatcttaggtgaggttgaggagaaggattcacagtcttgccttcactccccaaacatcagacatcattccttgtcacccactcagaatgagccccccttggggaagaaaccacaccatttccagcaaagtccatggagcatccggtacttttaagaacacttgcccctttggatatgaatatgtgcacatgtgtgtgagcacatgtatgtgtgtgtgtgtgtctgccccaggtgtaggcggaaagctcaaaaggatttcttgtcctttgtaggaggatttttgaagtgttccccttctctttccccttgctcatccattcatcctgcagcttcaggacatttcaacacttacttgctttctatgctgagagctggtgggtggaaggagagggcgcttgtccataggaaatcagggtggtcgcctgccgaggcctggaccttggaacagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtacatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgattttttttttttttttttgcacagttaagagaaaaaatcaaacaagcagaaaaaaaaaagaaaaaagacttatcacggttctgctgaagcttttattttttactggatgatgattattgttattgttactttggcggtacaggactttattttattccatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccatttcttccgtttggattcttggtgcacgtgtgatatggtatttaaaagcaaagacaagcaacattgtcaaaaagctgtccttgccccccatcccccacccaaatcttttttccaaactcccccagggatcttccttaccccactggcagagcaaacatccaggggctgtccatgtggcttgcgggctcccagagaaaggaattgggccaactttgtcctgtgggatggaggccccttcacggcctccctcgaggcaaagttaatttgtagggtcaccattatgttgagtcatgagcagacagaaggagagaaaaggccatcttccttaccttcccctccaacttatcccgtaccctcccagggaaaatggtaccagactgagccatcaaaatcactgacaaagtttaggtgggaattttttttgcatgttggagagagaagggcttaaggtagcagggaagaagggggctttgtggggtcctaaattttaaggaataagtagaggaagacaagaaacagagtggtaggctggtcatttctcctggccacaagtccccccagatgcagcttttacccattctttgtccttccccataaggagagaccctgacatttcttggtagctgcaaatagtgccactaagtgaaggtggccatcatgccagttacttcctcaggaaaatattttcttgccttcttctttcagtatggttttaaatttgggaacagtggataacccaagtgtcccacaggccaaggtacattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatgggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatccccccccgccatccctcctggtcctcgtctacatcaagggcctcttcccctcttcctgccagctctcaggacaggtgactgggaggccttgaaccctcagcctcttcctttaaaaaaaacaaaacaaaacaaaactgtgggccatttatttgggattttggagttgtttggtttttgtttgtatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttattttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagtttttttttttttactacaaatttttgctcccccataaaattattttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacaaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaaccggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttagacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctgtgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataataaaaatgcagtttggga

SEQ ID NO: 22797 - DNA, 13786 bp, Homo sapiens
gcgagccgcggcggcagcaggcagcccgggagctccggcggcggccgagccagcggcggccccgctccctgccccctgcaaactttgcgagcagcccgcccggggggccgggggcgcgcccgggaggcccggctcggcccgcggccgagctctccgccgccgcagcgccagccgccgcagccaccaccgccgcagccccgcgcctccccggggagcagccggcggctcccgcggccccccagccccggccccagggcactgcccggcgagtgtctcggcaagggtgggggctgccgcggcgcggccggccgcgggctgccggggggcggccgccgctacccagagaggcgcgcagaggcgccgagagcgctccccggcgggtcccccgcgcactcgccgcgcccgggcagcggcccgaccgggcgagcatgggcggcgcggagtgacgccgctgtgcccgcttggcatcaaggacattcagcccgcgggggtggggacgaaggggggcagcccggcgtcgccaccgcagcccccgagagccgccgccgctgctcgggctccggggctgggtggaggaaaggggtgttcggaatcgatccccattttccgacctttttgttggacattacgcccaccttggacgccgcaagagaagctgtcaagccccgcaggctctgattcggcgccctccgcgttcctcggctgctcccggcttccctgtgcctcggtggagtatttgcgttcggggctggggctggaggaggcagccacacgcgcgcacacgcacacgttcagaggagggcgagaggcagcggcataggctccatctgcagtgtcaatgcggcgctcccgctgaaggagggaaacgcggcgcgtccaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagatccgggtggatggacccaggggcaacgccctccagtatgagacggtgcaggtggtggaccccggcccagtcctccgggatatggccttctccaaggaccacgagcaactctacatcatgtcagagaggcagctcaccagagtccctgtggagtcctgtggtcagtatcagagctgcggcgagtgccttggctcaggcgacccccactgtggctggtgtgtgctgcacaacacttgcacccggaaggagcggtgtgagcggtccaaggagccccgcaggtttgcctcggagatgaagcagtgtgtccggctgacggtccatcccaacaatatctccgtctctcagtacaacgtgctgctggtcctggagacgtacaatgtcccggagctgtcagctggcgtcaactgcacctttgaggacctgtcagagatggatgggctggtcgtgggcaatcagatccagtgctactcccctgcagccaaggaggtgccccggatcatcacagagaatggggaccaccatgtcgtacagcttcagctcaaatcaaaggagaccggcatgaccttcgccagcaccagctttgtcttctacaattgcagcgtccacaattcgtgcctgtcctgcgtggagagtccataccgctgccactggtgtaaataccggcatgtctgcacccatgaccccaagacctgctccttccaggaaggccgagtgaagctgcccgaggactgcccccagctgctgcgagtggacaagatcctggtgcccgtggaggtgatcaagcctatcacgctgaaggccaagaacctcccccagccccagtctgggcagcgtggctacgaatgcatcctcaacattcagggcagcgagcagcgagtgcccgccctgcgcttcaacagctccagcgtacagtgccagaacacctcttattcctatgaagggatggagatcaacaacctgcccgtggagttgacagtcgtgtggaatgggcacttcaacattgacaacccagctcagaataaagttcacctctacaagtgtggagccatgcgtgagagctgcgggctgtgcctcaaggctgacccagacttcgcatgtggctggtgccagggcccaggccagtgcaccctgcgccagcactgccctgcccaggagagccagtggctggagctgtctggtgccaaaagcaagtgcacaaacccccgcatcacagagataatcccggtgacaggcccccgggaagggggcaccaaggtcactatccgaggggagaacctgggcctggaatttcgcgacatcgcctcccatgtcaaggttgctggcgtggagtgcagccctttagtggatggttacatccctgcagaacagatcgtgtgtgagatgggggaggccaagcccagccagcatgcaggcttcgtggagatctgcgtggctgtgtgtcggcctgaattcatggcccggtcctcacagctctattacttcatgacactgactctctcagatctgaagcccagccgggggcccatgtccggagggacccaagtgaccatcacaggcaccaacctgaatgccggaagcaacgtggtggtgatgtttggaaagcagccctgtctcttccacaggcgatctccatcctacattgtctgcaacaccacatcctcagatgaggtgctagagatgaaggtgtcggtgcaggtggacagggccaagatccaccaggacctggtctttcagtatgtggaagaccccaccatcgtgcggattgagccagaatggagcattgtcagtggaaacacacccatcgccgtatgggggacccacctggacctcatacagaacccccagatccgtgccaagcatggagggaaggagcacatcaatatctgtgaggttctgaacgctactgagatgacctgtcaggcgcccgccctcgctctgggtcctgaccaccagtcagacctgaccgagaggcccgaggagtttggcttcatcctggacaacgtccagtccctgctcatcctcaacaagaccaacttcacctactatcccaacccggtgtttgaggcctttggtccctcaggaatcctggagctcaagcctggcacgcccatcatcctaaagggcaagaacctgatcccgcctgtggctgggggcaacgtgaagctgaactacactgtgctggttggggagaagccgtgcaccgtgaccgtgtcagatgtccagctgctctgcgagtcccccaacctcatcggcaggcacaaagtgatggcccgtgtcggtggcatggagtactccccggggatggtgtacattgccccggacagcccgctcagcctgcccgccatcgtcagcatcgcagtggctggcggcctcctcatcattttcatcgtggccgtgctcattgcctataaacgcaagtcccgcgaaagtgacctcacgctgaagcggctgcagatgcagatggacaacctggagtcccgtgtggccctggagtgcaaggaagcctttgccgagctgcagacggacatccatgagctgaccagtgacctggatggagccgggattccgttcctggactatagaacttacaccatgcgggtgctgttcccaggaattgaagaccaccctgtcctccgggaccttgaggtcccgggctaccggcaggagcgtgtggagaaaggcctgaagctcttcgcccagctcatcaacaacaaggtgttcctgctgtccttcatccgcacgcttgagtcccagcgtagcttctccatgcgcgaccgtggcaacgtggcctcactcatcatgaccgtgctgcagagcaagctggagtacgccactgatgtgctgaagcagctgctggccgacctcattgacaagaacctggagagcaagaaccaccctaagctgctgctcaggaggactgagtcagtggctgagaagatgctgaccaattggtttactttcctcctctacaagttcctcaaggagtgtgctggggagcccctcttctccctgttctgtgccatcaagcagcagatggagaagggccccattgacgccatcacgggcgaggcccgctactccttgagcgaggacaagctcatccgccagcagattgactacaaaaccctggtcctgagctgtgtcagcccagacaatgccaacagccccgaggtcccagtaaagatcctcaactgtgacaccatcactcaggtcaaggagaagattctggatgccatcttcaagaatgtgccttgctcccaccggcccaaagctgcagatatggatctggagtggcgacaaggaagtggggcaaggatgatcttgcaggatgaagacatcaccaccaagattgagaatgattggaagcgactgaacacactggcccactaccaggtgccagatggttccgtggtggcattagtgtccaagcaggtgacagcctataacgcagtgaacaactccaccgtctccaggacctcagcaagtaaatatgaaaacatgatccggtacacgggcagccccgacagcctccgctcacggacacctatgatcactcctgacctggagagtggagtcaagatgtggcacctagtgaagaaccacgagcacggagaccagaaggagggggaccgggggagcaagatggtgtctgaaatctacctgacccgactcctggccactaagggcacactgcagaagtttgtggatgacctctttgagaccatcttcagcacggcacaccgtggctctgccctgcccctggccatcaagtacatgtttgacttcctggatgagcaggctgataaacatggcattcatgacccgcacgtccgccatacctggaagagcaattgcctgcccctgaggttttgggtcaacatgatcaagaacccgcagtttgtgtttgacatccataagaacagcatcacagacgcctgcctctctgtggtggctcagaccttcatggactcttgctccacgtcagagcaccggctgggcaaggactcgccctccaacaagctgctgtatgccaaggacatccccagctacaagaattgggtggagaggtattactcagacatagggaagatgccagccatcagcgaccaagacatgaacgcatacctggctgagcagtcccggatgcacatgaatgagttcaacaccatgagtgcactctcagagatcttctcctatgtgggcaaatacagcgaggagatccttggacctctggaccacgatgaccagtgtgggaagcagaaactggcctacaaactagaacaagtcataaccctcatgagcttagacagctgagaaccgtccttccagggccgccctggagggggacacaccaagccgtgcctcagtctagattatcatctttaccaagtgcaagttccgactggcatcagcagcatcccctgagcagcgctgtttctctctctttctctctgcctctttccgtttctccctccttcctggatctcttctcttccagttgctctgccaacacgattggaccaagccactgaccctcagttagtccaagaatggccaggcccatggcaagggagctgaccagaagatgtcagagaggcctctgtctcccaggtgctcctgaccctgtgcatgtcagcagcagggtgcaaataacgaatgaggagccagggacaggggacatttctgtgctgctacttcaccttccactttggcagcccctgctttggtctgagccttggcctagggaagaggcaaggaaggacttcagtattatctttactgggaagacatcacctggctctcccttcccacagttccatctccagtggttcagccagtggtctgatcgctttgcagctgtgagaagaaaggctacacctcctgcatgtggctggagcagggcatgtgtgggcagctgggaggtgctccttgaggctccttctcccccactgggctggtgtccagaggcttcctgtccttttccaggtctccagagggacctgcctgccctgcctgctcccccgccagtagaaagccaggcaggagaaagaatagcaattacattccaccatggagatgctcctgaccttttcatctgaatcctagtagcagaaatgtaacacagggggagaaaaggaaagagagttgcatctaccctggaagcagaatttgttttccatttaccctcaaattcaaatgagtcacaatcatagtcataggtctagtccactaccagagccctgagtgctgtcaagagaaagcatctatctccaccctcctttgtcaaccttcatcaagggtcaacgtgaaatgcagagtgcatctaggagattctacctccagccatctccatggctccatccccatcatccttcctgagaactccatagacggctggggccaacagcctagtccctgttccctctgcagaatccggtgccattgctatgcagatgactttgtcactgggctgtccagacctctttgggaatgatttcatcaacatctcagctgtctctcatcattctccttcctcatctcttcagcagtcatccttgaaagaaacagacttaagcaaagcctcacggagacagcccaaaatgccagccaacctcagcctccagcttgtcagatctgggagggacaaagagtcgagctgatgggcctggctggaattaagaagagggacatacaaatgaccttggccttggcatccatctccccatctgttcttacatctacagatgcacgattttagccaggcaggcaaatgtgtgcctagaaattgatactaggtaagcagaggctatggggagagatggtctaatggagggttctaggaacctttcatcctaaggagaccttaggtgctgtctggtgcagtctcccatcctaagcaggagtctctgttggcacctctgctctggagttgttcaccactatgggagacaaggagaaacatcttaggtgaggttgaggagaaggattcacagtcttgccttcactccccaaacatcagacatcattccttgtcacccactcagaatgagccccccttggggaagaaaccacaccatttccagcaaagtccatggagcatccggtacttttaagaacacttgcccctttggatatgaatatgtgcacatgtgtgtgagcacatgtatgtgtgtgtgtgtgtctgccccaggtgtaggcggaaagctcaaaaggatttcttgtcctttgtaggaggatttttgaagtgttccccttctctttccccttgctcatccattcatcctgcagcttcaggacatttcaacacttacttgctttctatgctgagagctggtgggtggaaggagagggcgcttgtccataggaaatcagggtggtcgcctgccgaggcctggaccttggaacagggcatcatgtgacatcgcagaggacagatggtggaaaagacatgagcaacctaatgggaagaggaaaatgggaaacaatgcattggaagaggaagaaaaaaaataaataaccaaaggttttggcaagtgcagtaccaggtggagaagcttgacttttctatccttgatcattttattccctcccaagaagtcagtcacaggacctggaaggccagaaagggtacatgtgggagacggtctgaggaagtacctcggtcactacaatatttttgcacatataaagggttggggaggaaagagacacaaacgtatttaacacagatttgctggatggaagctgcgtgtgtgaacgtgtgtatgagtgagtgcattttgattttttttttttttttttgcacagttaagagaaaaaatcaaacaagcagaaaaaaaaaagaaaaaagacttatcacggttctgctgaagcttttattttttactggatgatgattattgttattgttactttggcggtacaggactttattttattccatgtttttgttataagaaaaatttcaaacacctcagagaaatagaaaggttaggaagaaagaggagacaaggacagacaaattttctggctgtccccatttctcctgggggaggggtttggggctggtttgactttaattggtgggtgggttgtttctgccgctctgtttgctgcagtccccgtggcctgcttggggactgagaaatttgagccaggtatccagagccacagcccatcttgcttataaaaattatcttctgctgtttgttttccatttcttccgtttggattcttggtgcacgtgtgatatggtatttaaaagcaaagacaagcaacattgtcaaaaagctgtccttgccccccatcccccacccaaatcttttttccaaactcccccagggatcttccttaccccactggcagagcaaacatccaggggctgtccatgtggcttgcgggctcccagagaaaggaattgggccaactttgtcctgtgggatggaggccccttcacggcctccctcgaggcaaagttaatttgtagggtcaccattatgttgagtcatgagcagacagaaggagagaaaaggccatcttccttaccttcccctccaacttatcccgtaccctcccagggaaaatggtaccagactgagccatcaaaatcactgacaaagtttaggtgggaattttttttgcatgttggagagagaagggcttaaggtagcagggaagaagggggctttgtggggtcctaaattttaaggaataagtagaggaagacaagaaacagagtggtaggctggtcatttctcctggccacaagtccccccagatgcagcttttacccattctttgtccttccccataaggagagaccctgacatttcttggtagctgcaaatagtgccactaagtgaaggtggccatcatgccagttacttcctcaggaaaatattttcttgccttcttctttcagtatggttttaaatttgggaacagtggataacccaagtgtcccacaggccaaggtacattccaatggcagcatgatccctgcacccaaagccagcccctaaagcctaccccttgtgcacccgcagcctggtaagtgagcttggctgcttgtgaggagctacaagtgaaagagaagttattttaaataaatcccaaagtttgaggcagactgtccaggactgttcccaggaagaagcaggagttacccacaggaaaagtctctgacctggtcccctcaggcccagctacctgcgcccaccagcagtgaaggttgatgtactggcccagcatctccacctcccccatgcaaccaggtccctggtaccgtgtctcccgttgcatgtctggcttctgcctgtgctcctcctgccacgagcatcctccctgtccctcctcattccaccgtgtctctcctgcacacatagcctctgtcccagggcgatttatccacttgagtacaggagctgctcagacctctcagcccagccctctgtgactgccccagccccatcctaccccacccaaagctgccttcctggctgtaggagctccctcgtctagccaaggccctatgggtccccatccgaggatccacaagcaatgacttcccaaatgacctccactgcaagaagaatccttaccactgtttccagagccgtgaacgatgctgtgatgggcccaggtctcagcaccaccctctgtgacctaaaaagaaaagctcaatttccatctgtcttctttcccaggaccaaggggacacagtaatgtgaagtcaaatacttaaccgagcaaagggccagtattgttatcagtcaaggacaaacctcccacctcacagacagccaagcagtgagggaaagacagacagacataggtaggaaggtgctctgcaggcacaaggcccagagaagcccctctccgggaacttcccctgctccttccaggaacagtgagcccagtgagcagccccagccagctcttcaaggccttcaaggggtctttccatgactgagtcacctccaggagctcacctgacccccagagaagacctaccccaggcagctccgtgccctggcttctccccatgccccaaatccccccccgccatccctcctggtcctcgtctacatcaagggcctcttcccctcttcctgccagctctcaggacaggtgactgggaggccttgaaccctcagcctcttcctttaaaaaaaacaaaacaaaacaaaactgtgggccatttatttgggattttggagttgtttggtttttgtttgtatatcttaatagttcgaaagtaagaagggagccctgctatggatgttaagtccaaattactcggttagtgggagcaaaacctatgacttccaaggggatgaggagaggttcagaggacaggaggagcctcccccattgaaaaaaaaaaatgggtcaggacattccctggatgaggacaatgctaggggtggcatctcacatggctgctgctattcctggtgcttccccacacttttgacagatggagtccttctcctaccgcctcctgccacctcaccctacaggcattctctatgtaggaaacaagagccttattttatagagtggggagctgagacacagcctcaggtaacactgacacagctcccgaatgaggctgggacactctgcaaacctctcctcatggtgctaagggtggcatgctcttgacaggaaacctaaatgaccactcctctcatttggaaagtaatccactgcagtaaaagtttcagacatgcaagagagagtttttttttttttactacaaatttttgctcccccataaaattattttattagagggagtatccaagttttaaaagtatatagaattttttggttgtaagagaaatacatactcattaggatcccgattaaattccttgagtagactggtgcctaccagaaagcaaagcaaagttaaacaaaacgaaacaaaatccttcatatacaaaaagaactttctgtttgtattggcagaggtagtgaggtgattcaggtaggctgaaaatcctgggttgcgggagcctcactttattccattcccacccgctttgatgtctatgcttggctctctgggctgcccctggtactgccgaatcctacacatctcttatcagctttcctcaaactttaaggaggctctgtgagggatgggtcatgggaagacccaagctttccctccgccaggattgcaaaagcaagtagacttggtctatgcagctcttcttccagcaatttctttatttggaattagaacttcctttgttagtatctttgatcttttgactcaagcacattttggaagggctcccttacaaaagtagaatttaaaacagaggatacagttaaagagcaacccaaaggacgcttaagaaaccgagaccacttcaccaaacaggactaaggaacactttcgtgcacagaagtcagccgcaatccaggcacaggacgaagatgggatacacgtgctcatctgtctgtcctcctttcctctccctccccgacgttctagttagcttgttgacttgttaaaccttctgttcttaaaatgaaaagctagcttacctcaaagaatcttgtttccattcggaaaccaacgattttgtgttttagaatggacagccctcccctcaccactccctaccttggcctggtgtccttgagacatacggtctttgcttagtcgtgtgttggctgctttgagcaggaacaaggcctccaggccctgaggtgggaaggaaggattggatgccactgccctcctccccactttagcatgtaggggccagcccatctcttccagcagggtcctgctgagttaccatagcaaccagcaactccagggtaccacaacagacaatggctcagcgagccgacgtgtggggatgatgcaggggttttggcccagccagaggacccagagttgagcttcaaatgctagagaaggggagaaacaggatggaagggtggtttaaggaaccggcaggggtctttgagtcacatagagaagccgttgaaggaggtagggcaggttatctctgttccagtcacccccttccagccccatcccacttctgtttcaaactaaagctcccacctcgaacattgaccctttgttagaacaaagcaaagcatatctttagacaacagtgttaaaatgagcctcaaatgtatgtggatgagatctctaagaagagggtcttctggttttgatttttaaagaagagtatcctagtaaaatattaaaaaaaaattaaaaagtttttaaaaaggaaacctgtgctatttaaattggagcccagttgtaacttggtaaaggcaagcttctgtacctttgttataattaattgtatacctgtgtatgtaaatataaggcattcctattttgcagttcagaacaaaaaaaacttatttgtaatatagaataaagtttattaaaaaataataaaaatgc

SEQ ID NO: 22798 - DNA, 2004 bp, Homo sapiens
atgagatgcagaccacatggagaccttaatgcatggagatcttgcccactagtagcgtggcccagcgttttgggacacagcccaatcagaccagtatttcccctctggagctggattgaggagggaacatggggactgaaaccttgaatgcttctgctttaattaccccgaaaagcaagtgccactgttagaaatggaaatcaggccagctgctggggcggcaagcagcaggaatgcaaatgtccatgacccctcagatccacacaaagccttctgaccttggaatttaagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagtccttcggcacaggtccacaagggggaatcacccaggagtggattggagtggagggagacccacctggggcgaacattgcttctcaggaacagatgctgtgtgtgtatcttcagtgctcaagtcacaaagcaatatcagatcagagagtccagcctctgctttgttgcttcctaaatgtacctgggaattcttcctaaaattactctggaaatttgaatccactttaactaaaaataaatattcatagcacagaaa

SEQ ID NO: 22799 - DNA, 3314 bp, Homo sapiens
agtgtcaatgcggcgctcccgctgaaggagggaaacgcggcgcgtccagtaggggagactgcattgctgagtcctggccctctgaggggacgactgtgcctgagtgctgctgtgccactgggacccgcctctgccatgaaagccatgccctggaactggacctgccttctctcccacctcctcatggtgggcatgggctcctccactttgctcacccggcagccagccccgctgtcccagaagcagcggtcatttgtcacattccgaggagagcccgccgagggtttcaatcacctggtggtggatgagaggacaggacacatttacttgggggccgtcaatcggatttacaagctctccagcgacctgaaggtcttggtgacgcatgagacagggccggacgaggacaaccccaagtgttacccaccccgcatcgtccagacctgcaatgagcccctgaccaccaccaacaatgtcaacaagatgctcctcatagactacaaggagaacaggctgattgcctgtgggagcctgtaccaaggcatctgcaagctgctgaggctggaggacctcttcaagctgggggagccttatcataagaaggagcactatctgtcaggtgtcaacgagagcggctcagtctttggagtgatcgtctcctacagcaacctggatgacaagctgttcattgccacggcagtggatgggaagcccgagtattttcccaccatctccagccggaaactgaccaagaactctgaggcggatggcatgttcgcgtacgtcttccatgatgagttcgtggcctcgatgattaagatcccttcggacaccttcaccatcatccctgactttgatatctactatgtctatggttttagcagtggcaactttgtctactttttgaccctccaacctgagatggtgtctccaccaggctccaccaccaaggagcaggtgtatacatccaagctcgtgaggctttgcaaggaggacacagccttcaactcctatgtagaggtgcccattggctgtgagcgcagtggggtggagtaccgcctgctgcaggctgcctacctgtccaaagcgggggccgtgcttggcaggacccttggagtccatccagatgatgacctgctcttcaccgtcttctccaagggccagaagcggaaaatgaaatccctggatgagtcggccctgtgcatcttcatcttgaagcagataaatgaccgcattaaggagcggctgcagtcttgttaccggggcgagggcacgctggacctggcctggctcaaggtgaaggacatcccctgcagcagtgcgctcttaaccattgacgataacttctgtggcctggacatgaatgctcccctgggagtgtccgacatggtgcgtggaattcccgtcttcacggaggacagggaccgcatgacgtctgtcatcgcatatgtctacaagaaccactctctggcctttgtgggcaccaaaagtggcaagctgaagaagatgcctggtaccagcctctgccctacccttgagctacagacgggaccccgatcccacagagcaacagtgactctggaactcctgttctccagctgttcatcaaactgagaaaaacttcagagctgtgtaggcttatttagtgtgttgtcagccttggatattggaaaatggaaacagatgagacacatctacctccctgtgaccccagccatacatcatagctcatgtcctgccaccccaagtccttagggaaaaaagactttggagaatgtgtctctgcttagcttggctaggtagttggtctcttttctctgccccaagcgtcccatgggtaattttggacaatggagtgtaggcatgtttgactcttgtggtgttatcacttgtatatgtcagtgaaactaactgattctcccatcggaatatagttatctcttgggcctgatatatggtaggataaccttatgctcatctgtccacttctgcagccaagtcgcctggccagtgtgtgtgtgtgtgtgtgtgtgtgtgtgtgtgtgtgtgtgtgtgtatgcttatctgtgtttaaaggtgtgtgtgcatacacagggcagagaggatggagcccaccgtactgcagcatcatgtaattaactcagtgctcagaaccatcccagcctctgcgggaaagagaaaaggaagccaacagtgcctgatgagctgatcatatgtgcaaaagctctgttggcatctggtccaggagagcacccaaaaaaagttaattggtgttgtccagtctcctttccttaagactatggttacaacaaagcgtgagcagtgtctcctgcatggccactatccagcacaattccataattcccccatagagccggtggggaggaggaggtgagtggcgaaggaagtggaaacacttggtgtcatgtgctcctatcatttctactagcttactgggaaataaagtgtagtcaagagtgtatgaaggcaagatgtaaaattagcgactggtgctaatctggttacttgaaaacaagtgaaagtgctgtagatttgttctgttgctaagaaccaccacactaaacctcgtatagttcctggaggatacacaacagtgtaattctctttagggtgtgccacaggttcctggcctgtgggagggaatgaatcaggagggctcttgagaaccttcatctgtgtgcttgcactgaaagtgagtcccaaagctggagatttagtgagagcaggcaacccctctgtgtctcactgtccatattctggaggcagaggtttgtaacaggccatgtgcacctgcatagggatgggtaaagcaaggactttgaaagagttgaaaagcattataaacagttgttcagaaatacgtcccaggagttccatgtgaaactggctctgtgtgcattgaagcatggctgttgggaattctaactggtccaacactcctgcaaaacaatgtgtaaatatttaggaagaaacttgaaaatagtcaaatcctttgaactggtgacaattttttaaagaatcaattctaatttgtttcaagggtaataatcaccaagatacacatttcagcatttatttagtctatcaaaaattggaattgatatatacactcatttataggagaatggttaggtagatttggtatatttatgtagtcattgaaaacttagtttataaaggccaatcttgtaactgattcttgtgtgataacattcagtgaaaaagcatgagacaattagaaagcatgatacaatgaataaaataaaaactggaaagagaaccatcaaaatgct

SEQ ID NO: 22800 - DNA, 6351 bp, Homo sapiens
cccgggcgccatcgagccttggcggcggacgtgcagagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctg

SEQ ID NO: 22801 - DNA, 1387 bp, Homo sapiens
cccagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgcggcccaggccagacagcgtggtcctggagtggcgtccgggctccacagcgcagatccgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggagcgccatgcctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtcacgaggtggtggacgcctcgctgtcagtcatcgcgcaga

SEQ ID NO: 22802 - DNA, 3701 bp, Homo sapiens
ttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctg

SEQ ID NO: 22803 - DNA, 1835 bp, Homo sapiens
atgtcctgtcctgatgagttggtggttcctgctgtagccatcggcctcgtgtgccccgagcgcctggcggtgcccacccctcccacaggaggtcctcaggaagcacggagacatcgagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacg

SEQ ID NO: 22804 - DNA, 609 bp, Homo sapiens
cagcgccgagcgcggcccgggcgccatcgagccttggcggcggacgtgcagagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcc

SEQ ID NO: 22805 - DNA, 1620 bp, Homo sapiens
atgtcctgtcctgatgagttggtggttcctgctgtagccatcggcctcgtgtgccccgagcgcctggcggtgcccacccctcccacaggaggtcctcaggaagcacggagacatcgagaatctcgatgctggcctggagcagaaactgagctggaccactggagcctcggtgagggggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccag

SEQ ID NO: 22806 - DNA, 6383 bp, Homo sapiens
atggcagcagcgcgggccagagcgcagcgccgagcgcggcccgggcgccatcgagccttggcggcggacgtgcagagaatctcgatgctggcctggagcagaaactgagctggaccactggagcctcgggtgcggggggcaatggcactgcagctctgggccctgaccctgctgggcctgctgggcgcaggtgccagcctgaggccccgcaagctggacttcttccgcagcgagaaagagctgaaccacctggctgtggatgaggcctcaggcgtggtgtacctgggggcggtgaatgccctctaccagctggatgcgaagctgcagctggagcagcaggtggccacgggcccggccctggacaacaagaagtgcacgccgcccatcgaggccagccagtgccatgaggctgagatgactgacaatgtcaaccagctgctgctgctcgaccctcccaggaagcgcctggtggagtgcggcagcctcttcaagggcatctgcgctctgcgcgccctgagcaacatctccctccgcctgttctacgaggacggcagcggggagaagtctttcgtggccagcaatgatgagggcgtggccacagtggggctggtgagctccacgggtcctggtggtgaccgcgtgctgtttgtgggcaaaggcaatgggccacacgacaacggcatcatcgtgagcactcggctgttggaccggactgacagcagggaggcctttgaagcctacacggaccacgccacctacaaggccggctacctgtccaccaacacacagcagttcgtggcggccttcgaggacggcccctacgtcttctttgtcttcaaccagcaggacaagcacccggcccggaaccgcacgctgctggcacgcatgtgcagagaagaccccaactactactcctacctggagatggacctgcagtgccgggaccccgacatccacgccgctgcctttggcacctgcctggccgcctccgtggctgcgcctggctctggcagggtgctatatgctgtcttcagcagagacagccggagcagtggggggcccggtgcgggcctctgcctgttcccgctggacaaggtgcacgccaagatggaggccaaccgcaacgcctgttacacaggcacccgggaggcccgtgacatcttctacaagcccttccacggcgatatccagtgcggcggccacgcgccgggctccagcaagagcttcccatgtggctcggagcacctgccctacccgctgggcagccgcgacgggctcagaggcacagccgtgctgcagcgtggaggcctgaacctcacggccgtgacggtcgccgccgagaacaaccacactgttgcttttctgggcacctctgatggccggatcctcaaggtgtacctcaccccagatggcacctcctcagagtacgactctatccttgtggagataaacaagagagtcaagcgcgacctggtactgtctggagacctgggcagcctgtacgccatgacccaggacaaggtgttccggctgccggtgcaggagtgcctgagctacccgacctgcacccagtgccgcgactcccaggacccctactgcggctggtgcgtcgtcgagggacgatgcacccggaaggccgagtgtccgcgggccgaggaggccagccactggctgtggagccgaagcaagtcctgcgtggccgtcaccagcgcccagccacagaacatgagccggcgggcccagggggaggtgcagctgaccgtcagccccctccctgccctgagcgaggaggacgagttgctgtgcctttttggggagtcgccgccacaccccgcccgcgtggagggcgaggccgtcatctgcaactccccaagcagcatccccgtcacaccgccaggccaggaccacgtggccgtgaccatccagctcctccttagacgaggcaacatcttcctcacgtcctaccagtaccccttctacgactgccgccaggccatgagcctggaggagaacctgccgtgcatctcctgcgtgagcaaccgctggacctgccagtgggacctgcgctaccacgagtgccgggaggcttcgcccaaccctgaggacggcatcgtccgtgcccacatggaggacagctgtccccagttcctgggacccagccccctggtgatccccatgaaccacgagacagatgtgaacttccagggcaagaacctggacaccgtgaagggttcctccctgcacgtgggcagtgacttgctcaagttcatggagccggtgaccatgcaggaatctgggaccttcgcctttcggaccccaaagctgtcccacgatgccaacgagacgctgcccctgcacctctacgtcaagtcttacggcaagaatatcgacagcaagctccatgtgaccctctacaactgctcctttggccgcagcgactgcagcctgtgccgggccgctaaccccgactacaggtgtgcgtggtgcgggggccagagcaggtgcgtgtatgaggccctgtgcaacaccacctccgagtgcccgccgcccgtcatcaccaggatccagcctgagacgggccccctgggtgggggcatccgcatcaccatcctggggtccaatttgggcgtccaagcaggggacatccagaggatctctgtggccggccggaactgctcctttcagccggaacgttactccgtgtccacccggatcgtgtgtgtgatcgaggctgcggagacgcctttcacggggggtgtcgaggtggacgtcttcgggaaactgggccgttcgcctcccaatgtccagttcaccttccaacagcccaagcctctcagtgtggagccgcagcagggaccgcaggcgggcggcaccacactgaccatccacggcacccacctggacacgggctcccaggaggacgtgcgggtgaccctcaacggcgtcccgtgtaaagtgacgaagtttggggcgcagctccagtgtgtcactggcccccaggcgacacggggccagatgcttctggaggtctcctacggggggtcccccgtgcccaaccccggcatcttcttcacctaccgcgaaaaccccgtactgcgagccttcgagccgctacgaagctttgccagtggtggccgcagcatcaacgtcacgggtcagggcttcagcctgatccagaggtttgccatggtggtcatcgcggagcccctgcagtcctggcagccgccgcgggaggctgaatccctgcagcccatgacggtggtgggtacagactacgtgttccacaatgacaccaaggtcgtcttcctgtccccggctgtgcctgaggagccagaggcctacaacctcacggtgctgatcgagatggacgggcaccgtgccctgctcagaacagaggccggggccttcgagtacgtgcctgaccccacctttgagaacttcacaggtggcgtcaagaagcaggtcaacaagctcatccacgcccggggcaccaatctgaacaaggcgatgacgctgcaggaggccgaggccttcgtgggtgccgagcgctgcaccatgaagacgctgacggagaccgacctgtactgtgagcccccggaggtgcagcccccgcccaagcggcggcagaaacgagacaccacacacaacctgcccgagttcattgtgaagttcggctctcgcgagtgggtgctgggccgcgtggagtacgacacacgggtgagcgacgtgccgctcagcctcatcttgccgctggtcatcgtgcccatggtggtcgtcatcgcggtgtctgtctactgctactggaggaagagccagcaggccgaacgagagtatgagaagatcaagtcccagctggagggcctggaggagagcgtgcgggaccgctgcaagaaggaattcacagacctgatgatcgagatggaggaccagaccaacgacgtgcacgaggccggcatccccgtgctggactacaagacctacaccgaccgcgtcttcttcctgccctccaaggacggcgacaaggacgtgatgatcaccggcaagctggacatccctgagccgcggcggccggtggtggagcaggccctctaccagttctccaacctgctgaacagcaagtctttcctcatcaatttcatccacaccctggagaaccagcgggagttctcggcccgcgccaaggtctacttcgcgtccctgctgacggtggcgctgcacgggaaactggagtactacacggacatcatgcacacgctcttcctggagctcctggagcagtacgtggtggccaagaaccccaagctgatgctgcgcaggtctgagactgtggtggagaggatgctgtccaactggatgtccatctgcctgtaccagtacctcaaggacagtgccggggagcccctgtacaagctcttcaaggccatcaaacatcaggtggaaaagggcccggtggatgcggtacagaagaaggccaagtacactctcaacgacacggggctgctgggggatgatgtggagtacgcacccctgacggtgagcgtgatcgtgcaggacgagggagtggacgccatcccggtgaaggtcctcaactgtgacaccatctcccaggtcaaggagaagatcattgaccaggtgtaccgtgggcagccctgctcctgctggcccaggccagacagcgtggtcctggagtggcgtccgggctccacagcgcagatcctgtcggacctggacctgacgtcacagcgggagggccggtggaagcgcgtcaacacccttatgcactacaatgtccgggatggagccaccctcatcctgtccaaggtgggggtctcccagcagccggaggacagccagcaggacctgcctggggagcgccatgccctcctggaggaggagaaccgggtgtggcacctggtgcggccgaccgacgaggtggacgagggcaagtccaagagaggcagcgtgaaagagaaggagcggacgaaggccatcaccgagatctacctgacgcggctgctctcagtcaagggcacactgcagcagtttgtggacaacttcttccagagcgtgctggcgcctgggcacgcggtgccacctgcagtcaagtacttcttcgacttcctggacgagcaggcagagaagcacaacatccaggatgaagacaccatccacatctggaagacgaacagcttaccgctccggttctgggtgaacatcctcaagaacccccacttcatctttgacgtgcatgtccacgaggtggtggacgcctcgctgtcagtcatcgcgcagaccttcatggatgcctgcacgcgcacggagcataagctgagccgcgattctcccagcaacaagctgctgtacgccaaggagatctccacctacaagaagatggtggaggattactacaaggggatccggcagatggtgcaggtcagcgaccaggacatgaacacacacctggcagagatttcccgggcgcacacggactccttgaacaccctcgtggcactccaccagctctaccaatacacgcagaagtactatgacgagatcatcaatgccttggaggaggatcctgccgcccagaagatgcagctggccttccgcctgcagcagattgccgctgcactggagaacaaggtcactgacctctgacctacaatctccagtgctgccttgggacataggtacctgaggtacctgagagcccctcaggggaggaggccgagtggctgtggctgaggcccccaccctcccctggaacgcgccccaagccggagtgggtgcagccggaacccgcccagcgtctagactgtagcatcttcctctgagcaataccgccgggcaccgcaccagcaccagccccagccccagctccctccggccgcagaaccagcatcgggtgttcactgtcgagtctccagtgatttgaaaatgtgccttacgctgccacgctgggggcagctggcctccgcctccgcccacgcaccagcagccgcctccatgccctaggttgggcccctgggggatctgagggcctgtggcccccagggcaagttcccagatcctatgtctgtctgtccaccacgagatgggaggaggagaaaaagcggtacgatgccttcctgacctcaccggcctccccaagggtgccggcactctgggtggactcacggctgctgggccccacgtcaaaggtcaagtgagacgtaggtcaagtcctacgtcggggcccagacatcctggggtcctggtctgtcagacaggctgccctagagccccacccagtccggggggactgggagcagttccaagaccaccccacccctttttgtaaatcttgttcattgtaaatcaaatacagcgtctttttcactctg

SEQ ID NO: 22807 - DNA, 6146 bp, Homo sapiens
gctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttatttta

SEQ ID NO: 22808 - DNA, 774 bp, Homo sapiens
agagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacagagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctgg

SEQ ID NO: 22809 - DNA, 526 bp, Homo sapiens
ctgcctcgcagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggtgagagcagtgccagcagcagcagctggcaggggcttgaggaggaaaggcttatgggggaagcctagagggctgtgcacagagctctgggtgggcagtggcagcatcatgggggcaccttcacctccgagctcatgcctagcgcctcccctccctccggagcaggattccccagtgaacaaactgctctacgcccgggagatccc

SEQ ID NO: 22810 - DNA, 489 bp, Homo sapiens
caaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagagtgagtccctcggccctgacctggggccactggagtccaggctgggcaggca

SEQ ID NO: 22811 - DNA, 3106 bp, Homo sapiens
atcgccactgccctggggcagctgaactgagcgtatgtgccacgccgcccaggagacccctctgctgcaccacttcatggattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacaggtgggtgcggaggcggggggacagggtacccacgaggcctgaactcacacctcggcgcctcctggccccgcagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccct

SEQ ID NO: 22812 - DNA, 961 bp, Homo sapiens
agctgctacttggccctcgccggtggcccaccaggacaatgcccccccgcagccatctcatgcccatcgccactgccctggggcagctgaactgagcgtatgtgccacgccgcccaggagacccctctgctgcaccacttcatggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccggcctgcctgcctccttccactgctggctggagctgcctggagaacttcggggactgccggccaccctggaggagacagcaggggattcaggcctcatccactgccaggcccaccaggtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggtgaggcacttggagggtgaagatgggtggggaggccctcagagatgg

SEQ ID NO: 22813 - DNA, 5089 bp, Homo sapiens
agctgctacttggccctcgccggtggcccaccaggacaatgcccccccgcagccatctcatgcccatcgccactgccctggggcagctgaactgagcgtatgtgccacgccgcccaggagacccctctgctgcaccacttcatggattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttatttt

SEQ ID NO: 22814 - DNA, 6377 bp, Homo sapiens
gatgagtcggactgggcacgattgcattgtggggagggaggctggggctctgtgagacgtgctcctggcaccgccagctgctacttggccctcgccggtggcccaccaggacaatgcccccccgcagccatctcatgcccatcgccactgccctggggcagctgaactgagcgtatgtgccacgccgcccaggagacccctctgctgcaccacttcatgcacccccgctgccttgccccagtgcttcctcgccctggagctgggcgccagcatggagctcacccctgcctcttcgctgacttgctccttgctcagcccgcggctgcctggctctttcccccagctgcggagggttcctccttgcagccggccctggctgcccaaggcccccgtgatggctcgctggcctcccttcggcctctgcctcctcctgctgctgctgtccccaccgccactgcccttgacaggggcccatcgcttctccgcacctaataccactctcaaccacttggcactggcacctggccgaggcacactctatgtcggcgcagtgaaccgcctcttccagctcagccccgagctgcagctcgaggccgtggctgtcactggccctgtaatcgacagccctgactgcgtgcccttccgtgacccagccgagtgcccacaggcccagctcactgacaatgccaaccagctgctgctggtgagcagccgcgcccaggagctggtggcctgcgggcaggtgcggcagggcgtgtgtgagacacggcgccttggggatgtggccgaggtgctgtaccaggctgaggaccctggtgacgggcagtttgtggctgccaataccccgggagtggcaacggtggggctggtggtgcccttgcccggccgggacctcctgcttgtggccagaggcctggcgggcaagctgtcggcaggggtgccacccctggccatccgccagctggccgggtctcagcccttctccagcgagggcctgggccgcctggtggtgggcgacttctccgactacaacaacagctacgtcggggcctttgccgacgcccgctccgcctacttcgtgttccgccgccgcggggcccgggcccaggctgagtaccgctcctacgtggcccgcgtctgcctgggggacaccaacctgtactcctacgtggaggtccccctcgcctgccagggccagggcctcatccaggccgccttccttgccccgggcaccttgctaggggtgtttgccgcgggcccaaggggcacccaggcggcgctctgtgccttccccatggtggagctgggtgccagcatggagcaggcccggagactctgctacacggcgggcggccggggccccagcggcgcagaggaagccaccgtggagtacggcgtcacgtcgcgctgcgtcaccctgccccttgattcccccgagtcgtacccctgtggcgacgagcacacccccagccccattgctggccgccagcccctggaggtccagcctctgctgaagctcgggcagccggtcagcgccgtggcagctctccaggcagatgggcacatgatagccttcctgggggacacccagggccagctgtacaaggtctttctccacggctcccagggccaggtttaccactcccagcaagtggggcctccaggctcagccatcagcccagacctgctgctggacagcagtggcagtcacctctatgtcctgactgcccaccaggtggaccggatacctgtggcagcctgcccccagttccctgactgtgccagctgcctccaggcccaggacccgctgtgtggctggtgtgtcctccagggcaggtgtacccggaagggccagtgcgggcgggcaggccagctgaaccagtggctgtggagttatgaggaggacagccactgcctgcacatccagagcctgctgccgggccaccacccccgccaggagcagggccaggtcactttgtctgtcccccggctgcccatcctggatgcagatgaatacttccattgtgcgttcggggactatgacagcttggctcatgtggaagggccccacgtggcctgtgtcacccctccccaagaccaggtgccacttaaccctccaggcacagaccacgtcactgtgcccctggccctgatgttcgaggacgtgactgtggctgccaccaacttctccttttatgactgcagtgccgtccaggccttggaggcggctgccccgtgtcgcgcttgcgtgggcagcatctggcggtgtcactggtgcccgcagagtagccactgcgtgtacggagagcactgcccagagggcgagaggaccatctacagcgcccaggaggtggacatccaggtgcgtggcccaggggcttgcccacaggtcgaaggcctggcaggtccccacctggtgcctgtgggctgggagagccatttggccctacgcgtgcggaaccttcaacatttccgaggcctgcctgcctccttccactgctggctggagctgcctggagaacttcggggactgccggccaccctggaggagacagcaggggattcaggcctcatccactgccaggcccaccagttttatccctccatgtcccagcgggagctcccagtgcccatctacgtcacccagggtgaagcccagaggctggacaacacccatgctctttatgtgatcctgtacgactgcgccatgggccacccggactgcagccactgccaagcggccaacaggagcctgggctgcctgtggtgtgctgacggccagcctgcctgtcgctatgggcccttgtgcccgccgggggctgtggagctgctgtgtcctgcgcccagcattgatgcagtcgagcccctgaccggtccccctgagggaggcttggccctcaccatcctgggctccaacctgggccgggccttcgccgatgtgcagtacgccgtgagcgtggccagccggccctgcaaccctgagccctctctctaccgcacgtcggcccggattgtgtgtgtgacatctcctgcccccaatggcaccactgggcccgtccgggtggccattaagagccagccaccaggcatctcaagccagcacttcacctaccaggaccctgtcctgctgagcctgagtcctcgctggggcccccaggcagggggcacccagctcaccatccgaggtcagcacctccagacaggtggcaacaccagtgccttcgtgggtggccaaccctgtcccatcctggagccagtgtgtccggaggccatcgtgtgccgtaccaggccccaggctgccccaggagaagcagcggtccttgtggtctttggccatgcccagcgcacactgctcgccagccccttccgctacaccgccaacccccagcttgtagcggcggagcccagtgccagcttccgggggggtgggcgactgatccgtgtcaggggcaccggcctagacgtggtgcagcggcccctactgtctgtgtggctggaggctgacgcagaggtgcaggcttccagggcccagccccaggacccacagccaaggaggagctgtggagcccctgctgcggacccccaggcttgtatccagctcggtggggggctgctgcagtgctccaccgtctgctccgtcaactcgtccagcctcctcctgtgccggagccctgctgtaccagacagagcccacccgcagcgggtcttcttcaccctagacaacgtgcaagtggacttcgccagtgccagtgggggccagggcttcctgtaccagcccaacccccgcctggcacccctcagccgcgaggggcctgcccgcccctaccgcctcaagccaggccatgtcctggatgtggagggcgagggcctcaacctgggcatcagcaaggaggaggtgcgcgtgcacatcggccgcggcgagtgcctggtgaagacgctcacgcgcacccacctgtactgcgagccgcctgcgcacgccccgcagcctgccaatggctccggcctgccacagttcgtggtgcagatgggcaatgtgcagctggccctgggccctgtgcagtacgaggctgaacccccgctgtctgcctttcccgtggaggcccaggcaggcgtgggcatgggtgctgcagtgctgattgccgccgtgctcctcctcaccctcatgtacaggcacaagagcaagcaggccctgcgggactaccagaaggtgctagtgcagctggagagcctggagaccggcgtgggagaccagtgccgcaaggagttcacagacctcatgacggagatgaccgacctcagcagcgacctggagggcagcgggatccccttcctggactaccgcacctacgccgagcgcgccttcttccctggccatggcggttgcccgctgcagcccaagcctgaggggccaggggaggacggccactgtgccactgtgcgccagggcctcacgcagctctccaacctgctcaacagcaagctcttcctcctcacgctcatccacaccctggaggagcagcccagcttttcccagagggatcgctgccatgtggcttcgctgctgtcgctagcgctacacggcaagctggagtacctgacggacatcatgaggaccctgctgggtgacctggcggcccattacgtgcacaggaaccccaagctcatgctacgcaggacagagaccatggtggagaaactgctcaccaactggctgtccatctgcctgtacgccttcctgagggaggtggctggtgaaccactgtacatgctcttccgggccatccagtaccaggtggacaaaggccccgtggacgccgtgacaggcaaggccaaacggaccctgaatgatagccgcttgctgcgggaggacgtggagttccagcccctgacgctgatggtgctggtggggcccggggctggcggggccgcaggcagcagcgagatgcagcgcgtgccagcccgggtgctcgacacggacaccatcacccaggtcaaggagaaggtgttggaccaagtctacaagggcacccccttctcccagaggccctcagtgcatgccctagaccttgagtggcgctcaggcctggctggtcacctgaccctatcggacgaagacttgacctccgtgacccaaaaccactggaagagactcaacaccttgcaacactacaaggtcccagatggagcaacagtggggctcgtccctcagctgcaccgtggcagcaccatctcccagagcctggcccagaggtgccccttgggagagaacatacccacgctggaggatggcgaggaggggggggtgtgcctctggcacctggtgaaagccaccgaggagccagaaggggccaaggtgcggtgcagcagcctgcgggagcgcgagccagcaagggccaaggccattccggaaatctacctcacccgtctgctgtccatgaagggcacgctgcagaagtttgtggacgacaccttccaggccattctcagcgtgaaccggcccatccccatcgccgtcaagtacctgtttgaccttctggatgagctagcagagaagcacggcatcgaggacccagggaccctgcacatctggaagaccaacagtctgctgctgcggttctgggtgaatgccttgaagaacccacagctcatctttgatgtacgggtgtcggacaatgtggacgccatccttgctgtcatcgcccagaccttcattgactcctgtaccacctcggagcataaagtgggccgggattccccagtgaacaaactgctctacgcccgggagatcccacgctacaagcagatggtggagaggtactatgcggacattcgccagagctctccggcgagctaccaggagatgaactctgctttggctgagctctccgggaactacacttctgctccccactgtctggaggctctgcaagaactctacaaccacatccacaggtactatgatcagattatcagtgccctggaggaggaccctgtgggccagaagctgcagctggcctgccgcctgcagcaggtcgccgccctggtggaaaacaaagtgactgacctgtgagctctggctcagacagcagcaagccggatccaccaacaccgcagcgccttatgaccccggaaccgagccagccactgaggggagctggcagagcctgggggcacagggtgcaaagccaggcactgtgcccagcagtgggctccctgcctgccacctcccctgccagcccacccaccttccccccacctgagattgtttctaatttataaggatccccctccttccccctctccccattgtatttatttgcctgctggaaaatcacatccggaaataaaatagaaatatgtctttttattttattttg

SEQ ID NO: 22815 - DNA, 7094 bp, Homo sapiens
ccgggctgcgcggcgaggctgacccgggcccgggcgccggggtcgggggcggctggcgcgggcaggaagcgcatcgcggcccgggcccgccccccgcctcccgccgcctccgggctcccggctcccggccgcgcctcgccccatgcactcgccgcgccgcgcagcccgcgcacgcccggatggctcctcgcgccgcgggcggcgcaccccttagcgcccgggccgccgccgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgtgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctacgggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcatgtggagtgatggctgccgcctgcgggggcctctgcagcccatggctggcacctgccccgcccccgagatccacgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccactctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcagtgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacagccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctactgtgggctccagcctttgtcctgagatagccaagcggg

SEQ ID NO: 22816 - DNA, 7101 bp, Homo sapiens
ccgggctgcgcggcgaggctgacccgggcccgggcgccggggtcgggggcggctggcgcgggcaggaagcgcatcgcggcccgggcccgccccccgcctcccgccgcctccgggctcccggctcccggccgcgcctcgccccatgcactcgccgcgccgcgcagcccgcgcacgcccggatggctcctcgcgccgcgggcggcgcaccccttagcgcccgggccgccgccgccagccccccgccgttccagacgccgccgcggtgcccggtgccgctgctgttgctgctgctcctgggggcggcgcgggccggcgccctggagatccagcgtcggttcccctcgcccacgcccaccaacaacttcgccctggacggcgcggcggggaccgtgtacctggcggccgtcaaccgcctctatcagctgtcgggcgccaacctgagcctggaggccgaggcggccgtgggcccggtgcccgacagcccgctgtgtcacgctccgcagctgccgcaggcctcgtgcgagcacccgcggcgcctcacggacaactacaacaagatcctgcagctggaccccggccagggcctggtagtcgtgtgcgggtccatctaccagggcttctgccagctgcggcgccggggcaacatctcggccgtggccgtgcgcttcccgcccgccgcgccgcccgccgagcccgtcacggtgttccccagcatgctgaacgtggcggccaaccacccgaacgcgtccaccgtggggctagttctgcctcccgccgcgggcgcggggggcagccgcctgctcgtgggcgccacgtacaccggttacggcagctccttcttcccgcgcaaccgcagcctggaggaccaccgcttcgagaacacgcccgagatcgccatccgctccctggacacgcgcggcgacctggccaagctcttcaccttcgacctcaacccctccgacgacaacatcctcaagatcaagcagggcgccaaggagcagcacaagctgggcttcgtgagcgccttcctgcacccgtccgacccgccgccgggtgcacagtcctacgcgtacctggcgctcaacagcgaggcgcgcgcgggcgacaaggagagccaggcgcggagcctgctggcgcgcatctgcctgccccacggcgccggcggcgacgccaagaagctcaccgagtcctacatccagttgggcttgcagtgcgcgggcggcgcgggccgcggcgacctctacagccgcctggtgtcggtcttcccagcccgggagcggctctttgctgtcttcgagcggccccaggggtcccccgcggcccgcgctgctccggccgcactctgcgccttccgcttcgccgacgtgcgagccgccatccgagctgcgcgcaccgcctgcttcgtggaaccggcgcccgacgtggtggcggtgctcgacagcgtggtgcagggcacgggaccggcctgtgagcgcaagctcaacatccagctccagccagagcagctggactgtggagctgctcacctgcagcacccgctgtccatcctgcagcccctgaaggccacgcccgtgttccgcgccccgggcctcacctccgtggccgtggccagcgtcaacaactacacagcggtcttcctgggcacggtcaacgggaggcttctcaagatcaacctgaacgagagcatgcaggtggtgagcaggcgggtggtgactgtggcctatggggagcccgtgcaccatgtcatgcagtttgacccagcagactccggttacctttacctgatgacgtcccaccagatggccagggtgaaggtcgccgcctgcaacgtgcactccacctgtggggactgcgtgggtgcggcggacgcctactgcggctggtgtgccctggagacgcggtgcaccttgcagcaggactgcaccaattccagccagcagcatttctggaccagtgccagcgagggccccagccgctgtcctgccatgaccgtcctgccttccgagatcgatgtgcgccaggagtacccaggcatgatcctgcagatctcgggcagcctgcccagcctcagtggcatggagatggcctgtgactatgggaacaacatccgcactgtggctcgggtcccaggccctgcctttggtcaccagattgcctactgcaacctcctgccgagggaccagtttccgcccttcccccccaaccaggaccacgtgactgttgagatgtctgtgagggtcaatgggcggaacatcgtcaaggccaatttcaccatctacgactgcagccgcactgcacaagtgtacccccacacagcctgtaccagctgcctgtcggcacagtggccctgtttctggtgcagccagcagcactcctgtgtttccaaccagtctcggtgcgaggcctcaccaaaccccacgagccctcaggactgcccccggaccctgctctcacccctggcacccgtgcctacgggtggctcccagaacatcctggtgcctctggccaacactgcctttttccagggtgcagccctggagtgtagttttgggctggaggagatcttcgaggctgtgtgggtgaatgagtctgttgtacgctgtgaccaggtggtgctgcacacgacccggaagagccaggtgttcccgctcagcctccaactaaaggggcggccagcccgattcctggacagccctgagcccatgacagtcatggtctataactgtgccatgggcagccccgactgttcccagtgcctgggccgcgaagacctgggtcacctgtgcatgtggagtgatggctgccgcctgcgggggcctctgcagcccatggctggcacctgccccgcccccgagatccacgcgattgagcccctgagtggcccgttggacggtgggaccctgctgaccatccgaggaaggaacctgggccggcggctcagtgacgtggcccacggcgtgtggattggtggtgtggcctgtgagccactgcctgacagatacacggtgtcggaggagatcgtgtgtgtcacagggccagccccaggaccactctcaggtgtggtgaccgtgaacgcctctaaggagggcaagtcccgggaccgcttctcctacgtgctgcccctggtccactccctggagcctaccatgggccccaaggccgggggcaccaggatcaccatccatgggaatgacctccatgtaggctccgagctccaggtcctggtgaacgacacagacccctgcacggagctgatgcgcacagataccagcatcgcctgcaccatgcctgagggggccctgccggctccggtgcctgtgtgtgtgcgcttcgagcgtcggggctgcgtgcacggcaacctcaccttctggtacatgcagaacccggtcatcacggccatcagtccccgccgcagccctgtcagtggcggcaggaccatcacagtggctggtgagcgtttccacatggtgcagaatgtgtccatggccgtccaccacattggccgggagcccacgctctgcaaggttctcaactccaccctcatcacctgcccgtcccccggggccctgagcaacgcatcagcgccagtggacttcttcatcaatgggcgggcctacgcagacgaggtggctgtggctgaggagctactggaccccgaggaggcacagcggggcagcaggttccgcctggactacctccccaacccacagttctctacggccaagagggagaagtggatcaagcaccaccccggggagcctctcaccctcgttatccacaaggagcaggacagcctggggctccagagtcacgagtaccgggtcaagataggccaagtaagctgcgacatccagattgtctctgacagaatcatccactgctcggtcaacgagtccctgggcgcggccgtggggcagctgcccatcacaatccaggtagggaacttcaaccagaccatcgccacactgcagctggggggcagcgagacggccatcatcgtgtccatcgtcatctgcagcgtcctgctgctgctctccgtggtggccctgttcgtcttctgtaccaagagccgacgtgctgagcgttactggcagaagacgctgctgcagatggaggagatggaatctcagatccgagaggaaatccgcaaaggcttcgctgagctgcagacagacatgacagatctcaccaaggagctgaaccgcagccagggcatccccttcctggagtataagcacttcgtgacccgcaccttcttccccaagtgttcctccctttatgaagagcgttacgtgctgccctcccagaccctcaactcccagggcagctcccaggcacaggaaacccacccactgctgggagagtggaagattcctgagagctgccggcccaacatggaagagggaattagcttgttctcctcactactcaacaacaagcacttcctcatcgtctttgtccacgcgctggagcagcagaaggactttgcggtgcgcgacaggtgcagcctggcctcgctgctgaccatcgcgctgcacggcaagctggagtactacaccagcatcatgaaggagctgctggtggacctcattgacgcctcggccgccaagaaccccaagctcatgctgcggcgcacagagtctgtggtggagaagatgctcaccaactggatgtccatctgcatgtacagctgtctgcgggagacggtgggggagccattcttcctgctgctgtgtgccatcaagcagcaaatcaacaagggctccatcgacgccatcacaggcaaggcccgctacacactcagtgaggagtggctgctgcgggagaacatcgaggccaagccccggaacctgaacgtgtccttccagggctgtggcatggactcgctgagcgtgcgggccatggacaccgacacgctgacacaggtcaaggagaagatcctggaggccttctgcaagaatgtgccctactcccagtggccgcgtgcagaggacgtcgaccttgagtggttcgcctccagcacacagagctacatccttcgggacctggacgacacctcagtggtggaagacggccgcaagaagcttaacacgctggcccattacaagatccctgaaggtgcctccctggccatgagtctcatagacaagaaggacaacacactgggccgagtgaaagacttggacacagagaagtatttccatttggtgctgcctacggacgagctggcggagcccaagaagtctcaccggcagagccatcgcaagaaggtgctcccggaaatctacctgacccgcctgctctccaccaagggcacgttgcagaagtttctggatgacctgttcaaggccattctgagtatccgtgaagacaagcccccactggctgtcaagtactttttcgacttcctggaggagcaggctgagaagaggggaatctccgaccccgacaccctacacatctggaagaccaacaggtggcggccttcctctccggttctgggtgaacatcctgaagaacccccagtttgtctttgacatcgacaagacagaccacatcgacgcctgcctttcagtcatcgcgcaggccttcatcgacgcctgctccatctctgacctgcagctgggcaaggattcgccaaccaacaagctcctctacgccaaggagattcctgagtaccggaagatcgtgcagcgctactacaagcagatccaggacatgacgccgctcagcgagcaagagatgaatgcccatctggccgaggagtcgaggaaataccagaatgagttcaacaccaatgtggccatggcagagatttataagtacgccaagaggtatcggccgcagatcatggccgcgctggaggccaaccccacggcccggaggacacaactgcagcacaagtttgagcaggtggtggctttgatggaggacaacatctacgagtgctacagtgaggcctgagacacatggagagttggtcaggctgctgctgggagaaatggacgcccactgggcctcaacttgatcttctaccccgtgcctgtgactcagactgggaaatactgagcagagacggctggggcgggggcaggaggaggggctgctctctgagacaggggcgcccccgccttgacccctgggcacctccatcccctcccacctgtccccagatcagtctctgggatggaggccagagagctggtcaggctcccccatctgcccagcacggcctgcactgtgcccacccacttgctccacaacgtccagttggtcctgctgccaagagccccgtgcatccaggcggccaagcacaaactgggggagaggaggccgccagcccggaggctgcagcccagaaactctacctcatccacactggtgcagggagccctccttgaactgacctttgattggtttctgcttcaactaccaaaatgttatctccacttccccctcacccgtagaggatcctggccacagacagtttcaagtagtgtcagatttttgttgcttgggcggctgttggtagagtgggcagtgcccgcgccatggggtgctctgtgggcttctccaggagcagggagggtggaggggagggatggggggcacaggagctgggagccccgtctccaggaaaaggagaggggttaagatgcaccgaggctgtagctgggctacttgatcttgctgaaagtgtttctaaagatagcaccacttttttttttaaagcttttatatattaaaaaacgtatcatgcaccaactgtgaatagctgccgcttgcgcagaggacccggggaggggtcccgagaggctccccatgcaacactggaaatgactgttccagagagcgggcagacctggcagagcgcccctggcgcctgagactaccacccactccgttcctgccagaaacgaccctctgtggccgatgggccatgcgggcccctcgcagccaactcagccagtgttgggactggctcagagcccatgggggctggaggggggcagctgggactctggaatcttctttataataaaagccttacggacaaacctactgtgggctccagcctttgtcctgagatagccaagcggg

SEQ ID NO: 22817 - DNA, 6218 bp, Homo sapiens
agctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagatcctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtctatgctgtca

SEQ ID NO: 22818 - DNA, 1226 bp, Homo sapiens
agctccccgcctgctcccggaggccgcagcctccagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagtagagatgaggtttcaccgtgttag

SEQ ID NO: 22819 - DNA, 6251 bp, Homo sapiens
agctccccgcctgctcccggaggccgcagcctccagctccgctcgcgctctcgccgctcctgccggctcgcccggccccgcgctccgccgtctcctcgccgcccgcccctccgccagccccggggaccgcgcggccgcagcctgagccagggccccctccctcgtcaggaccggggcagcaagcaggccgggggcaggtccgggcacccaccatgcgaggcgagctctggctcctggtgctggtgctcagggaggctgcccgggcgctgagcccccagcccggagcaggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagaggtccctcaacaaccaggatgaaaacacgtatgtgaattgcctggattctcagcagtgtcacggcagctcagagtcaaggcgacctttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctccaactccttgtctctcaacgtattggctatgacgcagcaagcagaatgaatttggactcagttacaggctgtcaatggtctgctctgtagcagtctcagagcctccccgacccactacctggagatagccagatagccagatgccctgctcctggccacctttaaagcccctgcatatgacacaggttaactaaagtcaagattggggctgctgcattccaggttccctagactcacaagctggtccttggccaggtgcagtggctcacgcctgtaatcccagcactttgggaggctgaggcaggcggatcacctgaagtcagaagtttgagaccagcctggccaacataattaaaatgtctctactaaaaatacaaaaaattagctgggtgtggtgacgcttgcctgtatcccagctactcaggaagctgagacacgagaatcacttgaacctgggaggcagaggttgcagtgagctcagatagtgccactgcactccagcctgggtgacagagcgagactccgtctcaaaaaaaaaaaaagaaagcagatcctcatggctatagagttggcattttagccccagcttctgtagctctgaaagcctaaagaaggtattctctccatctgttaaacacagtatagtggctctcagcccttggggcatgttatcatgggagggaagtcaaataagaggagagaaaagaactcaagggggaaactgcatttttaggctttgctctcttaccttgccctttctactcagaaccaataacttctgcatcaaaacatgttacagcctgcatcaagggctttaccccaacctgcagcccagccttccctgggtgagcttgctatgcgcagccacatttaccatgtggggctccctattctgatggcctgttcggtgccgggtttactcactgccctgttctgatgtcagtgcctgtacatacctccaaaggcaggacttgcctgataaatatttttcctcctctgaactggattttataggcattaaagacaagtcgggtggctagagggctccttgagacatacctagcagggaactgcaggtggattctgttgagaggcaaagcacctgagtggttgggacacaggcagctggcatgggagggactttttttgagacagggtctcactgtgtcgcccagggcaaggatgcccaaagacaccaggttggagaggcacctgccaactacttgctttccctggagcctgcatgtgcctgtggggtggggaggcgtaggggtctacggctgcctgagatgggtgtgcacagtgtgtgaagtacctacctccttgccttgctggactgtcagccagtcgcagggccggccacaagacccatgtctccatctggtcatactccatagctaccaagttaacctgctctaaactttggagaactggatctgtccaataaacgcttatttggccaagcctgatggctcgtgcctgtactcccagcactttgggaggctgaggtgggagggttgcttgagcccaggggtttgagaccagcttgggcaacaacaacaaaaatgccaggtgtggtggggtgcacctgtagtcccagctactagggaggctgagccaggaggatcacttgagcccgggaggttgaggctgcagtggggggtcataatcatgccactgtactccagcctgggtgacagagtgagaccctgtctccgaaaaaaaaaaaaaaaaaaagaacggaaaaagaaatgcttacattgtcagggatcctgtagacaatcattaactctatgagatgcttggttctatttttttgggagactttgtccaagtgttttggcttaagaaatccataggcctctcttggtgacacatctctagtactttttgtcataaacaaacaggccatctgccgccaaatacatccactccccatgccactgacatcctatgggtcagccaggcttgctttgactgaggccgaggcatctggaactttctctgcctgcaggggctagcagcagaggcttcaccgcatcaccaccccttcctccactcctgacattctttcccttcagggatccaaaatggttggccgagctcccagtgggaaaacgtgtgctagagttggggagtgagatgagtggtgctgtccatggaatcaggccacagcaggaactgccccactggccatttgagacacacacaggtggtaaatgctctgctggtgggctgtgcttccctcattcagagagctctgttacagcccactgtgtcctttagaagcttgaaaggaacccaactctttgctgcactgtcctttttcttcctcaaattcagaccctccttccaccggcacccccctactccaccctcagctcttccttgcctggtttatcaagcagagctgaggccccacgtttccaactctgattgtcacttgcatcttcacaaaggataaaccacggagcaactggaaaaccatcagccaagcgttcggatgagtctggttattggtccacccccgaccagattcccttacacttaactcacttctttctttggcaatgaccctcatgacatgtataaatgggtatgactaagaagaggctgtgatctaacatttatttgctgccattttttactctggggagaagcagccccaactcatcactgggaaagaactccccctgcaaaccagctaaatttgataatttaaaccccctgcccctaaaacttctcacagagctggggagttggtggcaactttccaagtcaaggtcttgcttagaaagtccttcactacatggccaggtgcagtggctcacgcctgtagtcccaggtacttgggagcctgaggcaggaggattgcttgagctcaggagttcaaggctgcagagagctatgatcatcccactgcatttgtttaaaaataaatttttaaaatttgtgtgttttatcaggggtctcctgtacagtgtatctgtgtatgtttgtgtgtgtgtttgtatacagccttgtttaatgttttgagcaataagatatgcacacacaggtattttgttgctaaagagattggacaaggttgtagctgtgctcaggcttcagcttggtttgttaaattgagagataaacaatgacaagagctgccagccaaccacactattcaaaaagcaaagtgttcaccactaaagctaaccattcatctggttgcaggcaaggctaaggctctctctcctctagttcctggaacagactcacagattggcatgaagcactgatcaggggctgcactcagactccctggccaagcaaacctacaccagaagagtcagtgtcacagatatgatgcggccaatctctgtctccaaaaacctacctgaacttaatggtagaattcaaagatctggggactgagggcacccagccttctaaaacacaatgtattcatgtgtttagtgtaaactctctgcatggattctcagtgttaataataaaaggaagcattcttttacaactcctgctgtgtgcaaaagaaagtgcaaaggatttggagtggcattccgaagatcaccacacataccttggttctgatggctgctgaactccgacttcttcgctgagacatgactgtgggaacagcctccagctatctgctcatcagaggtgctttcctcaacctcctgcaccacctccaagagaaacagcctaaaaagaaaccccagctgtttacttatattggtctgtaaatccctggaagtaaaccccatgcatttttatctactgtctgaggacatacaataaatctgagaaagtctatgctgtc

SEQ ID NO: 22820 - DNA, 619 bp, Homo sapiens
cagctccttgccgtcacaagaacgaagtaggtcaggggagggaagaggcatcttcgtgtcctgacctgattccttgccgtctattaaatatcctacattgcgggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatg

SEQ ID NO: 22821 - DNA, 876 bp, Homo sapiens
ccaggatgccccctcaccccgtctcccactctccagcgccccagctccttgccgtcacaagaacgaagtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggcc

SEQ ID NO: 22822 - DNA, 268 bp, Homo sapiens
gcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccaggcttttcagcagagtctgcaaagcatctttggtgaaaagaaaagtcatgtgcaattagcagcatctgtttgcagaggcactcaaaacacacaggacagtgtatccg

SEQ ID NO: 22823 - DNA, 2082 bp, Homo sapiens
ctcctggaaaatttctccaatggcgctcagcgttcgcacccttcctctccgcggttttctagtccctaggccccagcccactagaagccaggatgccccctcaccccgtctcccactctccagcgccccagctccttgccgtcacaagaacgaagaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgacctgcctgcagcataggagctgtgacgcctgcatgtcctcagacctgaccttcaactgcagctggtgccatgtcctccagagatgctccagtggctttgaccgctatcgccaggagtggatggactatggctgtgcacaggaggcagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctc

SEQ ID NO: 22824 - DNA, 2722 bp, Homo sapiens
aagacagaccacgaggtaccccagatggaggaatgtgcaaagacgccggggctggagctggaatccgtcccgagacttctcaccttgacctcgaggaaggcaggaggtcggagacagggggtgggcaggctggggaaagaggaaacccgcaggacaagagggttgtggctcgtcacgtggccacttgagggcagcaagtagctgcagctggaggtagctgcctatctgattctgtttgagagtccgccaagttgggatttaaattagacatcaagaagaatttacagaccggccttgccttgttccacggtcacgatgagggcccaggctctggatgggctgccaaagggaccgtgcggggctggaaccggagagcccgagagagccctgggcatgtgtcagagccggacaggacccagctgagccaggacctgggtgggggcaccctggccatggacacgctgccagataacaggaccagggtggtggaggacaaccacagctattatgtgtcccgtctctatggccccagcgagccccacagccgggaactgtgggtagatgtggccgaggccaaccggagccaagtgaagatccacacaatactctccaacacccaccggcaggcttcgagagtggtcttgtcctttgatttccctttctacgggcatcctctgcggcagatcaccatagcaactggaggcttcatcttcatgggggacgtgatccatcggatgctcacagctactcagtatgtggcgcccctgatggccaacttcaaccctggctactccgacaactccacagttgtttactttgacaatgggacagtctttgtggttcagtgggaccacgtttatctccaaggctgggaagacaagggcagtttcaccttccaggcagctctgcaccatgacggccgcattgtctttgcctataaagagatccctatgtctgtcccggaaatcagctcctcccagcatcctgtcaaaaccggcctatcggatgccttcatgattctcaatccatccccggatgtgccagaatctcggcgaaggagcatctttgaatatcaccgcatagagctggaccccagcaaggtcaccagcatgtcggccgtggagttcaccccattgccgagtccctcaacaaccaggatgaaaacacgtatgtgaattgcctggattctcagcagtgtcacggcagctcagagtcaaggcgaccttgaggatcactggagctcatgcagtcctgctagcccctacacctactcacatgggcagatgtggccttggtcctggggagctgggtgggaaggaaggcagggatgccacaaataccttcatcttccggggaagtagagggaatgggagtgcctgactacctcagcctggggaccttggctcctcttctcactatcagcagagagctgttactgaacagtgaaaggggaaggcttctttgtcaatcccatcataactctgtccttttggtcctcctgcagatgctccagtggctttgaccgctatcgccaggagtggatggactatggctgtgcacaggagagggcaggatgtgcgaggacttccaggatgaggaccacgactcagcctcccctgacacttccttcagcccctatgatggagacctcaccactacctcctcctccctcttcatcgacagcctcaccacagaagatgacaccaagttgaatccctatgcaggaggagacggccttcagaacaacctgtcccccaagacaaagggcactcctgtgcacctgggcaccatcgtgggcatcgtgctggcagtcctcctcgtggcggccatcatcctggctggaatttacatcaatggccaccccacatccaatgctgcgctcttcttcatcgagcgtagacctcaccactggccagccatgaagtttcgcagccaccctgaccattccacctatgcggaggtggagccctcgggccatgagaaggagggcttcatggaggctgagcagtgctgagaacaccaagtctcccctttgaagactttgaggccacagaaaagacagttaaagcaaagaagagaagtgacttttcctggcctctcccagcatgccctgggctgagatgagatggtggtttatggctccagagctgctgctcgcttcgtcagcacaccccgaatattgaagagggggccaaaaaacaaccacatggattttttataggaacaacaacctaatctcatcctgttttgatgcaagggttctcttctgtgtcttgtaaccatgaaacagcagaagaactaacataactaactccatttttgtttaaggggcctttacctattcctgcacctaggctaggataactttagagcactgacataaaacgcaaaaacaggaatcatgccgtttgcaaaactaactctgggattaaaggggaagcatgtaaacagctaactgtttttgttaaagatttataggaatgaggaggtttggctattgtcacatgacagactgttagccaaggacaaagaagttctgcaaacctcccctggacccttgctggtgtccagatgtctgcggttgtcagccccttcctttcccccgacctaaacataaaagacaaggcaaagcccgcataattttaagacggttctttaggacattagtccaccatcttcttggtttgctggctctccgaaataaagtccctttccttgctcc

SEQ ID NO: 22825 - DNA, 3068 bp, Homo sapiens
ggcgacggcagcgcctcctccgccaccaaactcctggggctccgcgggggcttggggccacctcctcctgagcccggaggaaccctctcccgataggttccagcgtgactccctcccactccacccttttcctttcttcttcctcttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgagttttggcaggtctgatttaagaaaaactgaaggtgtattttcacatagtatgtcagtggtagacttcgtaattagactaaatcgtgtatatttttgcaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaa

SEQ ID NO: 22826 - DNA, 2822 bp, Homo sapiens
ggcgacggcagcgcctcctccgccaccaaactcctggggctccgcgggggcttggggccacctcctcctgagcccggaggaaccctctcccgataggttccagcgtgactccctcccactccacccttttcctttcttcttcctcttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgagagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaa

SEQ ID NO: 22827 - DNA, 2969 bp, Homo sapiens
ggcgacggcagcgcctcctccgccaccaaactcctggggctccgcgggggcttggggccacctcctcctgagcccggaggaaccctctcccgataggttccagcgtgactccctcccactccacccttttcctttcttcttcctcttttttttttttttttttaaacacatttttttcctggcttcggacctcagactgctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgcagcgtttggcccggtcgtgcctattgcatcgggagcccccgagcaccggcgaaggactggcgggtggggtagggaggtggcggcggcggcatggcgaggttcccgaaggccgacctggccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcctgaagaagacaagatttctggacaagctcagcccaggaaacaaagggtaaacaaaaaactaaaacttatacaagataccatttacactgaacatagaattccctagtggaatgtcatctatagttcactcggaacatctcccgtggacttatctgaagtatgacaagattataatgcttttggcttaggtgcagggttgcaaagggatcagaaaaaaaaaatcataataaagctttagttcatgagggatcgacacctttggttcaaatgttctctgatgtctcaaagataactgttttccaaagcctgaaccctttcactcaaaagagcaatgatgaatgtctcaagattgctaagaaaaacagcccatgcaagagtgagaacaaacacaaaataagagattttctacattttcaaaa

SEQ ID NO: 22828 - DNA, 2230 bp, Homo sapiens
gctgcagccctaaccttcccagggctcagctctttggagctgcccattcctccggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaagtcaccgtccgcgggcaccgggttggcgctgcccgagtggaaccgacagtttgcgagcctcggctgcaagtggcctctcctccccgcggttgttgttcagtgtcgggtgagggctgcgagtgtggcaagttgcaaagagagcctcagaggtccgaagagcgctgcgctcctactcgcgttcgcttcttcctcttctcggttccctactgtgaaatcgcagcgacatttacaaaggcctccgggtcctaccgagaccgatccgctgcaggagttatgttactttgccacttcttcacggaccagtttcagttcgccgatgggaaacccggagaccaaatccttgattggcagtatggagttactcaggccttccctcacacagaggaggaggtggaagttgattcacacgcgtacagccacaggtggaaaagaaacttggactttctcaaggcggtagacacgaaccgagcaagcgtcggccaagactctcctgagcccagaagcttcacagacctgctgctggatgatgggcaggacaataacactcagatcgaggaggatacagaccacaattactatatatctcgaatatatggtccatctgattctgccagccgggatttatgggtgaacatagaccaaatggaaaaagataaagtgaagattcatggaatattgtccaatactcatcggcaagctgcaagagtgaatctgtccttcgattttccattttatggccacttcctacgtgaaatcactgtggcaaccgggggtttcatatacactggagaagtcgtacatcgaatgctaacagccacacagtacatagcacctttaatggcaaatttcgatcccagtgtatccagaaattcaactgtcagatattttgataatggcacagcacttgtggtccagtgggaccatgtacatctccaggataattataacctgggaagcttcacattccaggcaaccctgctcatggatggacgaatcatctttggatacaaagaaattcctgtcttggtcacacagataagttcaaccaatcatccagtgaaagtcggactgtccgatgcatttgtcgttgtccacaggatccaacaaattcccaatgttcgaagaagaacaatttatgaataccaccgagtagagctacaaatgtcaaaaattaccaacatttcggctgtggagatgaccccattacccacatgcctccagtttaacagatgtggcccctgtgtatcttctcagattggcttcaactgcagttggtgtagtaaacttcaaagatgttccagtggatttgatcgtcatcggcaggactgggtggacagtggatgccctgaagagtcaaaagagaagatgtgtgagaatacagaaccagtggaaacttcttctcgaaccaccacaaccgtaggagcgacaaccacccagttcagggtcctaactaccaccagaagagcagtgacttctcagtttcccaccagcctccctacagaagatgataccaagatagcactacatctaaaagataatggagcttctacagatgacagtgcagctgagaagaaagggggaaccctccacgctggcctcatcattggaatcctcatcctggtcctcattgtagccacagccattcttgtgacagtctatatgtatcaccacccaacatcagcagccagcatcttctttattgagagacgcccaagcagatggcctgcgatgaagtttagaagaggctctggacatcctgcctatgctgaagttgaaccagttggagagaaagaaggctttattgtatcagagcagtgctaaaatttctaggacagaacaacaccagtactggtttacaggtgttaagactaaaattttgcctatacctttaagacaaacaaacaaacacacacacaaacaagctctaagctgctgtagcc

SEQ ID NO: 22829 - DNA, 2011 bp, Homo sapiens
agacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtcca

SEQ ID NO: 22830 - DNA, 2105 bp, Homo sapiens
acgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctactagagacagtgtttcaccatgtcagccaggctggtcttgaactcctgacctcgggtgatctgcccaccttggcctcccaaagtgctgggattacagcgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtcca

SEQ ID NO: 22831 - DNA, 5886 bp, Homo sapiens
agccgcgcagacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggtaactccagcaggggtgggaacccagactcgggtagaagaggctttaagacaagcacttacccattccctcctccctgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttc

SEQ ID NO: 22832 - DNA, 5988 bp, Homo sapiens
agccgcgcagacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgccgccgctgctgccgtcgtcgccgtcgccgtcgccgtcgccctcccagaatgaaacagcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctactagagacagtgtttcaccatgtcagccaggctggtcttgaactcctgacctcgggtgatctgcccaccttggcctcccaaagtgctgggattacagcgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggactttatagatgaactagtggaatcccttcattctgcagtgagattgccgagacctgaagagggtaagtgacttgcccaaggtcagagccacttggtgacagagccaggatgagaacaaagattccatttgcaccatgccacactgctgtgttcacatgtgccttccgtccagagcagtcccgggcaggggtgaaactccagcaggtggctgggctggaaaggagggcagggctacatcctggctcggtgggatctgacgacctgaaagtccagctcccaagttttccttctcctaccccagcctcgtgtacccatcttcccaccctctatgttcttacccctccctacactcagtgtttgttcccacttactctgtcctggggcctctgggattagcacaggttattcataaccttgaaccccttgttctggattcggattttctcacatttgcttcgtgagatgggggcttaacccacacaggtctccgtgcgtgaaccaggtctgcttaggggacctgcgtgcaggtgaggagagaaggggacactcgagtccaggctggtatctcagggcagctgatgaggggtcagcaggaacactggcccattgcccctggcactccttgcagaggccacccacgatcttctttgggcttccatttccaccagggactaaaatctgctgtagctagtgagagcagcgtgttccttttgttgttcactgctcagctgatgggagtgattccctgagacccagtatgaaagagcagtggctgcaggagaggccttcccggggccccccatcagcgatgtgtcttcagagacaatccattaaagcagccaggaaggacaggctttcccctgtatatcataggaaactcagggacatttcaagttgctgagagttttgttatagttgttttctaacccagccctccactgccaaaggccaaaagctcagacagttggcagacgtccagttagctcatctcactcactctgattctcctgtgccacaggaaaagagggcctggaaagcgcagtgcatgctgggtgcatgaagggcagcctgggggacagactgttgtgggaacgtcccactgtcctggcctggagctaggccttgctgttcctcttctctgtgagcctagtggggctgctgcggttctcttgcagtttctggtggcatctcaggggaacacaaagctatgtctattccccaatataggacttttatgggctcggcagttagctgccatgtagaaggctcctaagcagtgggcatggtgaggtttcatctgattgagaagggggaatcctgtgtggaatgttgaactttcgccatggtctccatcgttctgggcgtaaattccctgggatcaagtaggaaaatgggcagaactgcttaggggaatgaaattgccatttttcgggtgaaacgccacacctccagggtcttaagagtcaggctccggctgtagtagctctgatgaaataggctatccactcgggatggcttactttttaaaagggtagggggaggggctggggaagatctgtcctgcaccatctgcctaattccttcctcacagtctgtagccatctgatatcctaggggaaaaggaaggccaggggttcacatagggccccagcgagtttcccaggagttagagggatgcgaggctaacaagttccaaaaacatctgccccgatgctctagtgtttggaggtgggcaggatggagaacagtgcctgtttgggggaaaacaggaaatcttgttaggcttgagtgaggtgtttgcttccttcttgcccagcgctgggttctctccacccagtaggttttctgttgtggtcccgtgggagaggccagactggattattcctcctttgctgatcctgggtcacacttcaccagccagggcttttgacggagacagcaaataggcctctgcaaatcaatcaaaggctgcaaccctatggcctcttggagacagatgatgactggcaaggactagagagcaggagtgcctggccaggtcggtcctgactctcctgactctccatcgctctgtccaaggagaacccggagaggctctgggctgattcagaggttactgctttatattcgtccaaactgtgttagtctaggcttaggacagcttcagaatctgacaccttgccttgctcttgccaccaggacacctatgtcaacaggccaaacagccatgcatctataaaggtcatcatcttctgccacctttactgggttctaaatgctctctgataattcagagagcattgggtctgggaagaggtaagaggaacactagaagctcagcatgacttaaacaggttgtagcaaagacagtttatcatcagctctttcagtggtaaactgtggtttccccaagctgcacaggaggccagaaaccacaagtatgatgactaggaagcctactgtcatgagagtggggagacaggcagcaaagcttatgaaggaggtacagaatattctttgcgttgtaagacagaatacgggtttaatctagtctaggcaccagatttttttcccgcttgataaggaaagctagcagaaagtttatttaaaccacttcttgagctttatcttttttgacaatatactggagaaactttgaagaacaagttcaaactgatacatatacacatatttttttgataatgtaaatacagtgaccatgttaacctaccctgcactgctttaagtgaacatactttgaaaaagcattatgttagctgagtgatggccaagttttttctctggacaggaatgtaaatgtcttactggaaatgacaagtttttgcttgatttttttttttaaacaaaaaatgaaatataacaagacaaacttatgataaagtatttgtcttgtagatcaggtgttttgttttgtttttttaattttaaaatgcaaccctgccccctccccagcaaagtcacagctccatttcagtaaaggttggagtcaatatgctctggttggcaggcaaccctgtagtcatggagaaaggtatttcaagatctagtccaatctttttctagagaaaaagataatctgaagctcacaaagatgaagtgacttcctcaaaatcacatggttcaggacagaaacaagattaaaacctggatccacagactgtgcgcctcagaaggaataatcggtaaattaagaattgctactcgaaggtgccagaatgacacaaaggacagaattcctttcccagttgttaccctagcaaggctagggagggcatgaacacaaacataagaactggtcttctacactttctctgaatcatttaggtttaagatgtaagtgaacaattctttctttctgccaagaaacaaagttttggatgagcttttatatatggaacttactccaacaggactgagggaccaaggaaacatgatgggggaggcagagagggcaagagtaaaactgtagcatagcttttgtcacggtcactagctgatccctcaggtctgctgcaaacacagcatggaggacacagatgactctttggtgttggtctttttgtctgcagtgaatgttcaacagtttgcccaggaactgggggatcatatatgtcttagtggacaggggtctgaagtacactggaatttactgagaaacttgtttgtaaaaactatagttaataattattgcattttcttacaaaaatatattttggaaaattgtatactgtcaattaaagtgtttttgtgtaaactggttc

SEQ ID NO: 22833 - DNA, 2078 bp, Homo sapiens
agccgcgcagacgccgcccaggacgcagccgccgccgccgccgctcctctgccactggctctgcgccccagcccggctctgctgcagcggcagggaggaagagccgccgcagcgcgactcgggagccccgggccacagcctggcctccggagccacccacaggcctccccgggcggcgcccacgctcctaccgcccggacgcgcggatcctccgccggcaccgcagccacctgctcccggcccagaggcgacgacacgatgcgctgcgcgctggcgctctcggcgctgctgctactgttgtcaacgtcgccgtcgccctcccagaatgcaacccagactactacggactcatctaacaaaacagcaccgactccagcatccagtgtcaccatcatggctacagatacagcccagcagagcacagtccccacttccaaggccaacgaaatcttggcctcggtcaaggcgaccacccttggtgtatccagtgactcaccggggactacaaccctggctcagcaagtctcaggcccagtcaacactaccgtggctagaggaggcggctcaggcaaccctactaccaccatcgagagccccaagagcacaaaaagtgcagacaccactacagttgcaacctccacagccacagctaaacctaacaccacaagcagccagaatggagcagaagatacaacaaactctggggggaaaagcagccacagtgtgaccacagacctcacatccactaaggcagaacatctgacgacccctcaccctacaagtccacttagcccccgacaacccacttcgacgcatcctgtggccaccccaacaagctcgggacatgaccatcttatgaaaatttcaagcagttcaagcactgtggctatccctggctacaccttcacaagcccggggatgaccaccaccctaccgtcatcggttatctcgcaaagaactcaacagacctccagtcagatgccagccagctctacggccccttcctcccaggagacagtgcagcccacgagcccggcaacggcattgagaacacctaccctgccagagaccatgagctccagccccacagcagcatcaactacccaccgataccccaaaacaccttctcccactgtggctcatgagagtaactgggcaaagtgtgaggatcttgagacacagacacagagtgagaagcagctcgtcctgaacctcacaggaaacaccctctgtgcagggggcgcttcggatgagaaattgatctcactgatatgccgagcagtcaaagccaccttcaacccggcccaagataagtgcggcatacggctggcatctgttccaggaagtcagaccgtggtcgtcaaagaaatcactattcacactaagctccctgccaaggatgtgtacgagcggctgaaggacaaatgggatgaactaaaggaggcaggggtcagtgacatgaagctaggggaccaggggccaccggaggaggccgaggaccgcttcagcatgcccctcatcatcaccatcgtctgcatggcatcattcctgctcctcgtggcggccctctatggctgctgccaccagcgcctctcccagaggaaggaccagcagcggctaacagaggagctgcagacagtggagaatggttaccatgacaacccaacactggaagtgatggagacctcttctgagatgcaggagaagaaggtggtcagcctcaacggggagctgggggacagctggatcgtccctctggacaacctgaccaaggacgacctggatgaggaggaagacacacacctctagtccggtctgccggtggcctccagcagcaccacagagctccagaccaaccaccccaagtgccgtttggatggggaagggaaagactggggagggagagtgaactccgaggggtgtcccctcccaatccccccagggccttaatttttcccttttcaacctgaacaaatcacattctgtccagattcctcttgtaaaataacccactagtgcctgagctcagtgctgctggatgatgagggagatcaagaaaaagccacgtaagggacttt

SEQ ID NO: 22834 - DNA, 3010 bp, Homo sapiens
gacttgaatggaaggagcccgagcccgcggagcgcagctgagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacgctgaacctgcaaaacaaccgcctgacttcccgagggctcccagagaaggcgtttgagcatctgaccaacctcaattacctgtacttggccaataacaagctgaccttggcaccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccgcaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggtgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggacgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgca

SEQ ID NO: 22835 - DNA, 3287 bp, Homo sapiens
caaaacttgcgtcgcggagagcgcccagcttgacttgaatggaaggagcccgagcccgcggagcgcagctgagactgggggagcgcgttcggcctgtggggcgccgctcggcgccggggcgcagcagggaaggggaagctgtggtctgccctgctccacgaggcgccactggtgtgaaccgggagagcccctgggtggtcccgtcccctatccctcctttatatagaaaccttccacactgggaaggcagcggcgaggcaggagggctcatggtgagcaaggaggccggctgatctgcaggcgcacagcattccgagtttacagatttttacagataccaaatggaaggcgaggaggcagaacagcctgcctggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaaccagctggaaaagatctaccctgaggagctctcccggctgcaccggctggagacgctgaacctgcaaaacaaccgcctgacttcccgagggctcccagagaaggcgtttgagcatctgaccaacctcaattacctgtacttggccaataacaagctgaccttggcaccccgcttcctgccaaacgccctgatcagtgtggactttgctgccaactatctcaccaagatctatgggctcacctttggccagaagccaaacttgaggtctgtgtacctgcacaacaacaagctggcagacgccgggctgccggacaacatgttcaacggctccagcaacgtcgaggtcctcatcctgtccagcaacttcctgcgccacgtgcccaagcacctgccgcctgccctgtacaagctgcacctcaagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccgcaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggtgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggacgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgca

SEQ ID NO: 22836 - DNA, 2614 bp, Homo sapiens
caaaacttgcgtcgcggagagcgcccagcttgacttgaatggaaggagcccgagcccgcggagcgcagctgagactgggggagcgcgttcggcctgtggggcgccgctcggcgccggggcgcagcaggttccgtcagccctggcgcccaggcgcatctgactcggcaccccctgcaggcaccatggcccagagccgggtgctgctgctcctgctgctgctgccgccacagctgcacctgggacctgtgcttgccgtgagggccccaggatttggccgaagtggcggccacagcctgagccccgaagagaacgaatttgcggaggaggagccggtgctggtactgagccctgaggagcccgggcctggcccagccgcggtcagctgcccccgagactgtgcctgttcccaggagggcgtcgtggactgtggcggtattgacctgcgtgagttcccgggggacctgcctgagcacaccaaccacctatctctgcagaacaacaagctggagaagatccccccgggggccttcagcgagctgagcagcctgcgcgagctatacctgcagaacaactacctgactgacgagggcctggacaacgagaccttctggaagctctccagcctggagtacctggatctgtccagcaacaacctgtctcgggtcccagctgggctgccgcgcagcctggtgctgctgcacttggagaagaacgccatccggagcgtggacgcgaatgtgctgacccccatccgcagcctggagtacctgctgctgcacagcaaccagctgcgggagcagggcatccacccactggccttccagggcctcaagcggttgcacacggtgcacctgtacaacaacgcgctggagcgcgtgcccagtggcctgcctcgccgcgtgcgcaccctcatgatcctgcacaaccagatcacaggcattggccgcgaagactttgccaccacctacttcctggaggagctcaacctcagctacaaccgcatcaccagcccgcaggtgcaccgcgacgccttccgcaagctgcgcctgctgcgctcgctggacctgtcgggcaaccggctgcacacgctgccacctgggctgcctcgaaatgtccatgtgctgaaggtcaagcgcaatgagctggctgccttggcacgaggggcgctggtgggcatggctcagctgcgtgagctgtacctcaccagcaaccgactgcgcagccgagccctgggcccccgtgcctgggtggacctcgcccatctgcagctgctggacatcgccgggaatcagctcacagagatccccgaggggctccccgagtcacttgagtacctgtacctgcagaacaacaagattagtgcggtgcccgccaatgccttcgactccacgcccaacctcaaggggatctttctcaggtttaacaagctggctgtgggctccgtggtggacagtgccttccggaggctgaagcacctgcaggtcttggacattgaaggcaacttagagtttggtgacatttccaaggaccgtggccgcttggggaaggaaaaggaggaggaggaagaggaggaggaggaggaagaggaaacaagatagtgacaaggtgatgcagatgtgacctaggacgatggaccgccggactcttttctgcagcacacgcctgtgtgctgtgagccccccactctgccgtgctcacacagacacacccagctgcacacatgaggcatcccacatgacacgggctgacacagtctcatatccccaccccttcccacggcgtgtcccacggccagacacatgcacacacatcacaccctcaaacacccagctcagccacacacaactaccctccaaaccaccacagtctctgtcacacccccactaccgctgccacgccctctgaatcatgcagggaagggtctgcccctgccctggcacacacaggcacccattccctccccctgctgacatgtgtatgcgtatgcatacacaccacacacacacacatgcacaagtcatgtgcgaacagccctccaaagcctatgccacagacagctcttgccccagccagaatcagccatagcagctcgccgtctgccctgtccatctgtccgtccgttccctggagaagacacaagggtatccatgctctgtggccaggtgcctgccaccctctggaactcacaaaagctggcttttattcctttcccatcctatggggacaggagccttcaggactgctggcctggcctggcccaccctgctcctccaggtgctgggcagtcactctgctaagagtccctccctgccacgccctggcaggacacaggcacttttccaatgggcaagcccagtggaggcaggatgggagagccccctgggtgctgctggggccttggggcaggagtgaagcagaggtgatggggctgggctgagccagggaggaaggacccagctgcacctaggagacacctttgttcttcaggcctgtgggggaagttccgggtgcctttattttttattcttttctaaggaaaaaaatgataaaaatctcaaagctgatttttcttgttatagaaaaactaatataaaagcattatccctatccctgc

SEQ ID NO: 22837 - DNA, 5745 bp, Homo sapiens
agcgggactgagcgccgggagagacctgcgcaggcgcaggcgcgcgggaagggccagcctgggtggcccaccccgcgcctggcgggactggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaaggtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctccagcggctgtgtgcaatggggtcttttgtggaaatcaaggagcagacaggtttcatgtgtactgtcaccacgtgggatggaaccagaggcatggaagcaagacgctaaatgaagagggccataagggctgggattcccaggcaccttaggaacagcttgtctttttttttttcctctccaaaaaaaatgtttaagggacggtgtctcctgtcacccaggctggagtgcaatggcacgatcatagctcattgcagcctctaactccggggctcaagcaatcctcccacctcagcctaccaagtagctgtgaccacagctgcccctcaccatgctaagctaatttttttaattagatagtacataaacgtcccaaaattagaagataaaaagacatgagggatccattctaatttgtgtttggagtgtaatggtccagctccattcttctgcacatggatatccagttttacacaacactgtgaatgtaatgaatgccactgaatcatacactcaaaaatagctaaaatggcaaattgtctgttatctctttttaaccaccatttttgaaaattaattataccaaaaaaccattgaatagtgcactttatttatttatttatttgtttatttatttatttattttagaaataagagtctcactttgttgcccaggctggagtgcggtggcgtgatcatggctcattgcagcctcgacctgctgggctcgggctatccttccatctcagcctcccgagtagctgggactataggtgggcgccaccccacctggctaaatctctttttaacttttgtagagataggcatctcgctatgttgcctaggctgggctggaactcctgggctcaagtgctcctcctgccttggcctcccaaagcgctaggattacagatgtgagccaccgcgcccaccctgaaccttactttttttgctcagtttctggtaattcagagaatgcctcctgagttgttctacacccacctcatattccatgggagggctgtacagggcttttttaacgaggcctctaaggacaggcatttgtatcctttccagcctttcactattacaatgttgtagtgaataactttacacactgtcatttattttacttttttttttttttattttagagaaaggaatcttgccatcttgcccaggctggtctcaaattcctgggcccaaacaatcctcccgccttggcctcctaaagtactgggatttataggcataagccaccgtgcctggccaatgcacactgtcatttagctcatgttaacacctgagtgtaggacacactcctggaggtggaattgctgggccaaagagtatgtttcttgtcattgtgatagatattgacaaatgaaccctcacagaagttgtgctgagttctgttcccaccagcgacgtaggcgatgacctttttctggagggagggggcatccttggagtccacagagccaggaatggagagtgggcccagaattttggtataggtgttgtataaacttatagtaaggttaagaaaaccgccactatccttatcagagacttggcggggggcagggtatgatggagatcataaggaggctaaaacactccacaccctccctctgcattgctcctgcacaggagtcgggaatcttttcaggttgatacgatctcaccttgaggagctgtgaggtcccagaagcctctgggttgcagattgcttggggtgaaaatgtctgtgctactgaaatctaactttttacaaaaaattacgggctgggcgcagtggctcacgcctgtaatcccagcactttgggaggctgcagcgggtggatcacttgaggtaaggagttcaagaccagaccatagtgaaaccgtgtctctacaaaaaaaattagccaggtgtggtggtgcatgcttgtaatcccagctactcagaaggctgaggtgggagaatcccttgaacccgggaagtggaggctggagtaaaccatgatcgagttactgcactccagcctgggtgacaagagtgagactctgtctccaaaaaaaaaaaaaaaaaaaaaaaaaactggattgcctggctctactccgggcacagcatgcaggcccagttctgctgctctgctgtttgttctgctttcctccacatattggcatcaccctctggtgccaagatggctgctgcattccaggcatcacatccagactcagacccagagaagctgcccatccctacctgggtgagcctttgtaggaacgagaaaccgcatccagcagcagaaacctcacccagcagcgtcttttccggtctcattcaccagcgccgcccaccgctcaaccaatccctggccaaaagaatgggaccgcctggaaggctggaccaaacaggacctgccctctggggctggggagaggcccagatgaaggctgcaggacaggatggactcctagacctctgttaccagcagtgactacctctgtctgggtggttggaacatgtttgaattttattctaagtactgtctacaagttctgcaataaaccttgactcttcttttaataatgcaaa

SEQ ID NO: 22838 - DNA, 2891 bp, Homo sapiens
atggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 22839 - DNA, 1347 bp, Homo sapiens
atggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatatcccgtaacgccatcatcttcctggttctgggaatcctggtttttctgatcctgctggggatcgggatttatttctattggtccaaatgttcccgtgaggtcctttggcactgtcatctgtgtccctcgagtgagcatcaccagagctgccgtaattgagcacctactacgggctctgtgctgagtccttccagtgtgcctctcactgaatcctcaccccactgccatgaggtttcccccatttgactgatgagggtgcagagccagggagccttgttcactggttcattgattacatttacaaatattatttacagagtgggagaa

SEQ ID NO: 22840 - DNA, 3239 bp, Homo sapiens
actggccgccaactcccctccgctccagtcacttgtctggagcttgaagaagtgggtattccccttcccaccccaggcactggaggagcggccccccggggattccaggacctgagctccgggagctggactcgcagcgaccgcggcagagcgagcgggcgccgggaagcgaggagacgcccgcgggaggcccagctgctcggagcaactggcatggcccgagccatggccgccgcgtggccgctgctgctggtggcgctactggtgctgtcctggccacccccaggaaccggggacgtcgtcgtgcaggcgcccacccaggtgcccggcttcttgggcgactccgtgacgctgccctgctacctacaggtgcccaacatggaggtgacgcatgtgtcacagctgacttgggcgcggcatggtgaatctggcagcatggccgtcttccaccaaacgcagggccccagctattcggagtccaaacggctggaattcgtggcagccagactgggcgcggagctgcggaatgcctcgctgaggatgttcgggttgcgcgtagaggatgaaggcaactacacctgcctgttcgtcacgttcccgcagggcagcaggagcgtggatatctggctccgagtgcttgccaagccccagaacacagctgaggttcagaaggtccagctcactggagagccagtgcccatggcccgctgcgtctccacagggggtcgcccgccagcccaaatcacctggcactcagacctgggcgggatgcccaatacgagccaggtgccagggttcctgtctggcacagtcactgtcaccagcctctggatattggtgccctcaagccaggtggacggcaagaatgtgacctgcaaggtggagcacgagagctttgagaagcctcagctgctgactgtgaacctcaccgtgtactaccccccagaggtatccatctctggctatgataacaactggtaccttggccagaatgaggccaccctgacctgcgatgctcgcagcaacccagagcccacaggctataattggagcacgaccatgggtcccctgccaccctttgctgtggcccagggcgcccagctcctgatccgtcctgtggacaaaccaatcaacacaactttaatctgcaacgtcaccaatgccctaggagctcgccaggcagaactgaccgtccaggtcaaagagggacctcccagtgagcactcaggcatatcccgtaacgccatcatcttcctggttctgggaatcctggtttttctgatcctgctggggatcgggatttatttctattggtccaaatgttcccgtgaggtcctttggcactgtcatctgtgtccctcgagtacagagcatgccagcgcctcagctaatgggcatgtctcctattcagctgtgagcagagagaacagctcttcccaggatccacagacagagggcacaaggtgacagcgtcgggactgagaggggagagagactggagctggcaaggacgtgggcctccagagttggacccgaccccaatggatgaagaccccctccaaagagaccagcctccctccctgtgccagacctcaaaacgacgggggcaggtgcaagttcataggtctccaagaccaccctcctttcatttgctagaaggactcactagactcaggaaagctgttaggctcacagttacagtttattacagtaaaaggacagagattaagatcagcaaagggaggaggtgcacagcacacgttccacgacagatgaggcgacggcttccatctgccctctcccagtggagccatataggcagcacctgattctcacagcaacatgtgacaacatgcaagaagtactgccaatactgccaaccagagcagctcactcgagatctttgtgtccagagttttttgtttgtcttgagacagggtctggctctgttggcagactagagtacagtggtgagatcacagttcattgcagccttgacttctcaacgccaagtcatcctcccacctcagcctcctgagtagctatgactacaggtatgtgccaccacgtctggctaatctttttattatttgtaaagtcgaggtttccctgtgttgcccaggctggtcttgaactcttggctccaagtgatacttctgccttggcctcccaaagtgctgaattaagcagctcaccatccacacggctgacctcatacatcaagccaataccgtgtggcccaagacccccaccataaatcacatcattagcatgaaccacccagagtggcccaagactcccagatcagctaccaggcaggatattccaagggcttagagatgaatgcccaggagctgaggataaagggcccgatctttctttgggcaaggttaagcctttactgcatagcagaccacacagaagggtgtgggccaccagagaattttggtaaaaatttggcctctggccttgagcttctaaatctctgtatccgtcagatctctgtggttacaagaaacagccactgaccctggtcaccagaggctgcaattcaggccgcaagcagctgcctggggggtgtccaaggagcagagaaaactactagatgtgaacttgaagaaggttgtcagctgcagccactttctgccagcatctgcagccactttctgccagcatctgcagccagcaagctgggactggcaggaaataacccacaaaagaagcaaatgcaatttccaacacaagggggaagggatgcagggggaggcagcgctgcagttgctcaggacacgctcctataggaccaagatggatgcgacccaagacccaggaggcccagctgctcagtgcaactgacaagttaaaaaggtctatgatcttgagggcagacagcagaattcctcttataaagaaaactgtttgggaaaatacgttgagggagagaagaccttgggccaagatgctaaatgggaatgcaaagcttgagctgctctgcaagagaaaataagcaggacagaggatttgctctggacagagatggaagagccgggaacagagaagtgtggggaagagataggaaccagcaggatggcaggggcaaagggctcaagggtgaggaggccagtgggaccccacagagttggggagataaaggaacattggttgctttggtggcacgtaagctccttgtctgtctccagcacccagaatctcattaaagcttatttattgtacctcca

SEQ ID NO: 22841 - DNA, 5840 bp, Homo sapiens
cgcagccagagccacccgggccgccgaccgccgagccccgcgcccgccgcctgggccccgagccttctgcgccgcccgggtgcgtcccgccaccctcggaggacggccggccatggacgcctgcaagttggagccgagcgggagggtgtgagcgggccggggccaggagcccgcgccgcgcaaccgggcagccgggcgcgccgggggtgggtccctctccccagccccgctctgcgtggaagaagagggcggggaccggcgccgggaggagagcggaggaggcgaaggggcatgactcgtgcaacttgcggcgggcatctgccgagcctctgagccggcggcggcccggggcccggactgcggccgcgcggatcccacccagcccaccccgccccggccgacggctgcagctgacctggatccttcgagcgcccgccgaccgccagcgatcttccctcatcttccgggctggtttctgctgcgcgaggagcgctgccctcgccgcccctctcgccggacccccggcccccgatggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagaattcccctacaccccgtctcctcccgaacatgggcggcgcgccgggccggtgcccacggccatcattgggggcgtggcggggagcatcctgctggtgttgattgtggtcggcgggatcgtggtcgccctgcgtcggcgccggcacaccttcaagggtgactacagcaccaagaagcacgtgtatggcaacggctacagcaaggcaggcatcccccagcaccacccaccaatggcacagaacctgcagtaccccgacgactcagacgacgagaagaaggccggcccactgggtggaagcagctatgaggaggaggaggaggaggaggagggcggtggagggggcgagcgcaaggtgggcggcccccaccccaaatatgacgaggacgccaagcggccctacttcaccgtggatgaggccgaggcccgtcaggacggctacggggaccggactctgggctaccagtacgaccctgagcagctggacttggctgagaacatggtttctcagaacgacgggtctttcatttccaagaaggagtggtacgtgtagccccccttccagagcctctgtctgtgaccgctcctccccagcccctccccgcacgccccctgcccaccccccacctcccactccaggagctgaacagagacttgcccagctgcccaaagccagccccgaactcctggggggccaggggagcccagggcagccacgacttggctttgtgttttatttcctccctctcctccgcccttccccatggtgttgtgttcgactgtggctttagtgttactgtatcttccctttacgggccccacctgcctgccctctgtgtagggagccctgttctcgtcttgtgtacctgggcatccctccagggtttggggagccagcctcccccgcccccctacactggaatttgtttgtgtttcttcactgggggtggagggctcaaggggctctaagagggaaaagctccccacacccccagatgctgctcctcctcccggctagagggaacccaacacccaccagtgaaatctgatgcagctgggagtttggaccttgggtctagacagctggtgcgcccaagaggtagggggaggggtgcggcttctccccagttcccagggagtcttgtttgttaagcggggccttgggcagtgttttcctgctgagggtggttttacattttttttcctcattggcccacagagagtggagttggcctagctctgacgcgtcccctctttatccccaatgtgccccctccattaggggctccaggtgggctccagcccacacttgctctctgcctctgctgacacgtgcacacacacacacatgcacacactgctcctctctgcctgctttcccctggagtcccatgccctgccccatccagacactgcccaaggcccacccgtctatttccacctcattccccctttaagctgagaatggggtctgcctatagaagcttccagagacagctgagactgggtccccggtgcctccaccctaggatctcaggcctgccccaaactgcttcttacagcgtggaggtttctctgatttctcccttatctagcaacacttggttcttttggctagtcagggctgggatcccagggggatccacctgcaggagtcagaggtaaagaagcatccacacggagggtagtggggaaggaagcccacatggcagaagctctgcaaacacagtccgagggactgaggagtccatacaatgcctcacacacaaaggccattgtcaaagcctcgggcctggcagaaagtgaggggggtggggccgctaggccacctcctgctcagccacccctggtcctcattctgggatgaggggagggcctaggagaagccctccctttcagtgcagattcccttcttgaatgggacattgagttcctatcagccaccccagactgggtcttcccatgtatataatggaggaagacccctcccagccctctcagtcccccagctcaaagtgcctcagttcctccatctgctcccagatcccctggcactctagacaggcatgcccatgggaaggaccctgggatggagaggcaggcttcgcggcccttcatgcctgcccactgggattccagttaactcaccccagggtgtcaggggctctgcaggatggcaagtgttggggaggagggaggcagaccactctgtgccccacgggcactgacccaccctgccataggcttcctaagggagccccccaacccctcccctcccctccctggtgctgctattgaaccccctgccagctccatttctgccctggcaaccctgggcccagcaggtgggtcgtcgttgtctggccctcactgccctggccccagcccaggctgcccagtagccacgtagcagaagtctgaagccatgccagccctggtgcggctctcccctctacacatttggggtactggatagggtgaagttaggggagaaaattgtggagtctttccagccacagggcagagggaggtggaggagctgggctgcttttcccagcagtattagtgtcccccaggacaggggaccttttccacattacatcactgccccatcccaccttacaacactctggcccctctgcttggtccccttttcccccaggcaggaggcaatcccaggggcctgcctgatagaggcatttcctgtccctgtctcctcctgcatctcctttatcctgcactgccaccctctattccccattctgtgttggactttgaaggccccaagcccagccaaagcactgagttcccccttaagacacctccacaccctccccacaagcaaagcacaaattttggggtccatgtagcatgggccacgtaggaggctcctgacttgccaggggcccagcctcagcatacccaccgagcagctgccagcctgggctgagggtgggcatgaggcaggagtcagcacttggacctagggatgtgaggttttctgtgccccaagtttgtgggaaggtgggcactactgctgggcccacagacacagccagctggcaaaagggaggtctagcccagcagagagatgaggacattttgcttctccttcatgcccacagcatgagctgagcttctgctttgctggaaatgaaataaacttggtatgaattgtgccaaggcctccccagttgtcatcctgcctcttgttgccctccctgtccttgccccccaccccacacccatgcccctgtttccttacagattttgatattgttctaatgtgtaatagaaccagccgagtccccttttatcagaagggtctgaaaagcagcagcacagagtaggtgaacacaggcctgcaagtgcgaccacctcagacccagtacgtgtgcccacagtggacacactcacacctccaacacacccacgcgcaggcatgtgtacacgcatgtacacacgcatgcatgcacagccagatggccactcagcacagatgtggcagagggaatggtctgatcctgctgaaagccattaaggagaaacgaatttcccagtgcccgggctgcaagagagccttataggggccctgtttcctgggcatgcgcttcctctgccagccaacccccacttgcccaagtcactggtgcaataacttttctgccttcctcagagcagagaaattgggaattgtgttaggtgggtgtgggcagctctgctgagccaagcagacacggatgtcccctcttctgggaggagggtagtgctcccaggcctcaggagtccagacagagacccccaaagcctgactgccaacagaaaccctctcctagtgaggggcaggtgggtgtgccccaggtccccacacccacagggaggcttcacacactgcccagtaccggggatgccaggaggcaggcccctctgctgctgccactgctgccaacactgcccagcttgtgaggccaggaggagcccctgtcccactcggtgctgctgctcttctgacccctgctgtgaggaatgggattcttggtcgaaaaaattggttttccttttttgtataaatgaaaagaatccaggagaagctgccaccctcccctcccagcgtgatgcgctaccttgcttcggcgtcttgtcgccctttccgcctttggtccagggacagcccagcagatcctcctggttctgacctggggggtgtttgcatcacccccttttacttgtattaaaaaaaaatgatgggttgaaaatgtactgaggattaaaaatgtacttttttataaataaagtgtttaaaacaaa

SEQ ID NO: 22842 - DNA, 1059 bp, Homo sapiens
atggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagctttctgtcaacttatctatccgggcaaagggaggacaagagctaggatgttctga

SEQ ID NO: 22843 - DNA, 1377 bp, Homo sapiens
atggctcggatggggcttgcgggcgccgctggacgctggtggggactcgctctcggcttgaccgcattcttcctcccaggcgtccactcccaggtggtccaggtgaacgactccatgtatggcttcatcggcacagacgtggttctgcactgcagctttgccaacccgcttcccagcgtgaagatcacccaggtcacatggcagaagtccaccaatggctccaagcagaacgtggccatctacaacccatccatgggcgtgtccgtgctggctccctaccgcgagcgtgtggaattcctgcggccctccttcaccgatggcactatccgcctctcccgcctggagctggaggatgagggtgtctacatctgcgagtttgctaccttccctacgggcaatcgagaaagccagctcaatctcacggtgatggccaaacccaccaattggatagagggtacccaggcagtgcttcgagccaagaaggggcaggatgacaaggtcctggtggccacctgcacctcagccaatgggaagcctcccagtgtggtatcctgggaaactcggttaaaaggtgaggcagagtaccaggagatccggaaccccaatggcacagtgacggtcatcagccgctaccgcctggtgcccagcagggaagcccaccagcagtccttggcctgcatcgtcaactaccacatggaccgcttcaaggaaagcctcactctcaacgtgcagtatgagcctgaggtaaccattgaggggtttgatggcaactggtacctgcagcggatggacgtgaagctcacctgcaaagctgatgctaaccccccagccactgagtaccactggaccacgctaaatggctctctccccaagggtgtggaggcccagaacagaaccctcttcttcaagggacccatcaactacagcctggcagggacctacatctgtgaggccaccaaccccatcggtacacgctcaggccaggtggaggtcaatatcacagaaaagccccgcccccagaggggtctgggaagtgcagccaggctcctggcgggcaccgtggccgtgttcctcatcctagttgctgtgctcactgtcttcttcctgtacaaccggcagcagaagagcccaccggagacggatggggccgggaccgaccagcccctctcccagaagccggagccttctcccagcaggcaaagctcccttgtgcctgaggatatccaggttgtccacctggacccagggaggcagcagcagcaagaagaggaggacttgcagaagctgtccctgcagcccccctactatgatctgggggtctccccctcctaccacccctcggtaaggacaaccgaacctcgaggagagtgcccctag

SEQ ID NO: 22844 - DNA, 2856 bp, Homo sapiens
agaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagagacccccaacacagcaggcgcaggggccacaggcggcatcatcgggggcatcatcgccgccatcattgctactgctgtggctgccacgggcatccttatctgccggcagcagcggaaggagcagacgctgcagggggcagaggaggacgaagacctggagggacctccctcctacaagccaccaaccccaaaagcgaagctggaggcacaggagatgccctcccagctcttcactctgggggcctcggagcacagcccactcaagaccccctactttgatgctggcgcctcatgcactgagcaggaaatgcctcgataccatgagctgcccaccttggaagaacggtcaggacccttgcaccctggagccacaagcctggggtcccccatcccggtgcctccagggccacctgctgtggaagacgtttccctggatctagaggatgaggagggggaggaggaggaagagtatctggacaagatcaaccccatctatgatgctctgtcctatagcagcccctctgattcctaccagggcaaaggctttgtcatgtcccgggccatgtatgtgtgagctgccatgcgcctggcgtctcacatctcacctgttgatcccttagctttcttgccaaggatctagtgccccctgacctctggccaggccactgtcagttaacacatatgcattccatttgtgatgtctaccttggtggctccactatgacccctaacccatgagcccagagaaattcaccgtgataatggaatcctggcaaccttatctcatgaggcaggaggtggggaaggtgcttctgcacaacctctgatcccaaggactcctctcccagactgtgaccttagaccatacctctcaccccccaatgcctcgactcccccaaaatcacaaagaagaccctagacctataatttgtcttcaggtagtaaattcccaataggtctgctggagtgggcgctgagggctccctgctgctcagacctgagccctccaggcagcagggtcccacttaccccctccccaccctgttccccaaaggtgggaaagaggggattccccagcccaaggcagggttttcccagcaccctcctgtaagcagaagtctcagggtccagacccttccctgagcccccacccccaccccaattcctgcctaccaagcaagcagccccagcctagggtcagacagggtgagcctcatacagactgtgccttgatggccccagccttgggagaagaatttactgttaacctggaagactactgaatcattttacccttgcccagtggaataggacctaaacatcccccttccggggaaagtgggtcatctgaattgggggtagcaattgatactgttttgtaaactacatttcctacaaaatatgaatttatactttgaccagg

SEQ ID NO: 22845 - DNA, 2150 bp, Homo sapiens
agaattctttggcaggggcgaccttagaatcctggggaggagcgagaatggaatcccggggaggaacaggggtggaatccggggggcggggtcagaacgccaggagggggcggggccggagccagggtcggcttgactcgggggagcagcgggtggatcctgtgacgtcagcgggttcgaaccgccggagctgagcgagaggccgggggtgccgagccgggcggggagagctgggccgggagagcagaacagggaggctagagcgcagcgggaaccggcccggagccggagccggagccccacaggcacctactaaaccgcccagccgatcggcccccacagagtggcccgcgggcctccggccgggcccagtcccctcccgggccctccatggcccgggccgctgccctcctgccgtcgagatcgccgccgacgccgctgctgtggccgctgctgctgctgctgctcctggaaaccggagcccaggatgtgcgagttcaagtgctacccgaggtgcgaggccagctcgggggcaccgtggagctgccgtgccacctgctgccacctgttcctggactgtacatctccctggtgacctggcagcgcccagatgcacctgcgaaccaccagaatgtggccgccttccaccctaagatgggtcccagcttccccagcccgaagcctggcagcgagcggctgtccttcgtctctgccaagcagagcactgggcaagacacagaggcagagctccaggacgccacgctggccctccacgggctcacggtggaggacgagggcaactacacttgcgagtttgccaccttccccaaggggtccgtccgagggatgacctggctcagagtcatagccaagcccaagaaccaagctgaggcccagaaggtcacgttcagccaggaccctacgacagtggccctctgcatctccaaagagggccgcccacctgcccggatctcctggctctcatccctggactgggaagccaaagagactcaggtgtcagggaccctggccggaactgtcactgtcaccagccgcttcaccttggtgccctcgggccgagcagatggtgtcacggtcacctgcaaagtggagcatgagagcttcgaggaaccagccctgatacctgtgaccctctctgtacgctaccctcctgaagtgtccatctccggctatgatgacaactggtacctcggccgtactgatgccaccctgagctgtgacgtccgcagcaacccagagcccacgggctatgactggagcacgacctcaggcaccttcccgacctccgcagtggcccagggctcccagctggtcatccacgcagtggacagtctgttcaataccaccttcgtctgcacagtcaccaatgccgtgggcatgggccgcgctgagcaggtcatctttgtccgagaaacccccagggcctcgccccgagatgtgggcccgctggtgtggggggccgtgggggggacactgctggtgctgctgcttctggctggggggtccttggccttcatcctgctgagggtgaggaggaggaggaagagccctggaggagcaggaggaggagccagtggcgacgggggattctacgatccgaaagctcaggtgttgggaaatggggaccccgtcttctggacaccagtagtccctggtcccatggaaccagatggcaaggatgaggaggaggaggaggaggaagagaaggcagagaaaggcctcatgttgcctccacccccagcactcgaggatgacatggagtcccagctggacggctccctcatctcacggcgggcagtttatgtgtgacctggacacagacagagacagagccaggcccggccctcccgcccccgacctgaccacgccggcctagggttccagactggttggacttgttcgtctggacgacactggagtggaacactgcctcccactttcttgggacttggagggaggtggaacagcacactggacttctcccgtctctagggctgcatggggagcccggggagctgagtagtggggatccagagaggacccccgcccccagagacttggttttggctccagccttcccctggccccgtgacactcaggagttaataaatgccttggaggaaaacatc

SEQ ID NO: 22846 - DNA, 1549 bp, Homo sapiens
ggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaa

SEQ ID NO: 22847 - DNA, 3664 bp, Homo sapiens
agttcccaggagttcgacgcgggcgggtgccgaggggaggggagtggcggcggcggcgggcggctcccgcttcagcctcggcagtggcgtcggcgacggcggtgtcgaggcagccgccagcgttcggccaagtgtcagccggcagcgacggcgctagagctgggagctggggacgcgcgcgccggaccttccacagcctccgcccagagcctgaggcgccggggccgggggagccggggggcgggcgggcgagcgggccggggggagggtgggggatggcgcggaccctgcggccgtccccgctgtgtcctggaggcggcaaagcacaactttcctccgcttctctcctcggagccgggctcctgctgcagcccccgacgccacctccgctgctgctgctgctcttcccgctgctgctcttctccaggctctgtggtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatcctcctactactaccacccttcagcctacaattcagtggcatccctcaactgctgacatcgaggatctagcaacagaacctaaaaaattgcccttcccattgtcaactttggcaacaattaaggatgacacaattgccacgatcattgctagtgtagtgggtggggctctcttcatagtacttgtaagtgttttggctggaatattctgctataggagaagacggacgtttcgtggagactactttgccaagaactacattccaccatcagatatgcaaaaagaatcacaaatagatgttcttcaacaagatgagcttgattcttacccagacagtgtaaaaaaagaaaacaaaaatccagtgaacaatctaatacgtaaagactatttagaagagcctgaaaaaactcagtggaacaatgtagaaaatctcaataggtttgaaagaccaatggattattatgaagatctaaaaatgggaatgaagtttgtcagtgatgaacattatgatgaaaacgaagatgacttagtttcacatgtagatggttccgtaatttccaggagggagtggtatgtttagcaaccactgaatgtgacttaactatgtacaatgttcattcacactagttgatcattttcagattgttcatactttttcttgaggaagaataagctttttcaagttgattttcaagcttactttttatattctaatctgacaaatgaaaatgtaaaatctgagttcagtgtatctaagctgctttacaattttttttcaatgctgtactactgtctcaagatttaaattttaatgcagagtactttattggtgtgaggcacacaggtaagaagaaatgtcaacattaaatgtatgacttacttggtacaaaaattttttaaaaagggaactaccttgacattgtgtattaaatgtttacctaagactataatctcaagtatgatgtttgtttaacatatacctctcaaaatttatcaccactcaatgacactgcatcaaaattgactataaaactaattcaagaaatatttatatatattttttaatatacaaaaaatatttagcctgatggaatggctttccttttcaaacattattttctaagtttctatacaaatgaaatctttacctctgcatattaatgagccttgccataattactgtagagtggcttttcaaagatattttgttgcactaaaactgtggtagtaaactcagtgaacatgatgtgtggaagagcataattagctggtcaatatttttgtccaaaatacctgcaagagtaataaaatacatacctttcaaacatgataattattagtttttttttttcctttctggaacatggattttggtacattagcagtagccttattttaatgctttatgtcctaaacatactaatagaaatgaaaagacgcagagagagcatttcggaatactgaagtactagttttagaaatgagactttcagccaacaatctatagaaagaattttatggaccatcttgttttagttatttaatgttgatgttgttcaaatgggtaaatgtacagaaagaaaattttagagtaaacttggaactttggatataactagaaaaaactagattatagaattagtcggtaacacttgctaatggacattggcattcatctcctttttcctcctaagtgtatgtatgtgttttaagatttctgtttttacgattaaaactggaaacatgaggttttttgtttttgtttttttacataattacatatattccttctgaatcatttatcttttgagaaagaaatgttacctaaacttcaaatgtgctttttgtttgtgaggtaattaaattgcttctacagtggaggcttacaaaattattgtgacaactattttgaagctgaaaggatagtttttctattgctaagtcatttgaaaaagtgaccattttgccagtgaaatgaagtggaagttagtaggagaatcataaattaaatatattattttgttaataaaaaggcaaagtagtaggtactttttaaaccctcccaaccagccctttctcaatattcatcaaatctaaaacatttagggggcaaaattctaacatgttcatggtatcttgcaaatagtgaaagctttattctgaaggattataaactagttttcttcattttaactagcactattttgtggaaattagaaacctcttttatttctcttcccaaaagtaatacttattataaggctgtagtatcaggttaaggatacagataaataaagttcacttatatcttcttacaaa

SEQ ID NO: 22848 - DNA, 1876 bp, Homo sapiens
aggctctgtggtaggtgaacctcggcggccggcgtgggctgagggagccgccactgagggtgcgggcgccgcggccggctctgccagccgttctctggagcagcgaggcggttggttgtgcgagcgagtgccgaggactttggctggaaacttttcgccgcgcccggggcgaggccctggaagggccaggccagcgaatgctgagccggcggcccgctgccctcccccgcggccgcgcgggtcgccgtgcggatggccgagggttggcgatggtgcttcgtgcgccgaactccgggtttgctccggggaccgttacttcctcgctcattctctgggaaccctcgtgccttagctggaccaattattgtggagccacatgtcacagcagtatggggaaagaatgtttcattaaagtgtttaattgaagtaaatgaaaccataacacagatttcatgggagaagatacatggcaaaagttcacagactgttgcagttcaccatccccaatatggattctctgttcaaggagaatatcagggaagagtcttgtttaaaaattactcacttaatgatgcaacaattactctgcataacataggattctctgattctggaaaatacatctgcaaagctgttacattcccgcttggaaatgcccagtcctctacaactgtaactgtgttagttgaacccactgtgagcctgataaaagggccagattctttaattgatggaggaaatgaaacagtagcagccatttgcatcgcagccactggaaaacccgttgcacatattgactgggaaggtgatcttggtgaaatggaatccactacaacttcttttccaaatgaaacggcaacgattatcagccagtacaagctatttccaaccagatttgctagaggaaggcgaattacttgtgttgtaaaacatccagccttggaaaaggacatccgatactctttcatattagacatacagtatgctcctgaagtttcggtaacaggatatgatggaaattggtttgtaggaagaaaaggtgttaatctcaaatgtaatgctgatgcaaatccaccacccttcaaatctgtgtggagcaggttggatggacaatggcctgatggtttattggcttcagacaatactcttcattttgtccatccattgactttcaattattctggtgtttatatctgtaaagtgaccaattcccttggtcaaagaagtgaccaaaaagtcatctacatttcagatgttccatttaagcagacctcttccatagctgtagctggagcggtaattggagctgttcttgcccttttcatcattgctatctttgtgactgtgctgctgactcctcgaaaaaaaagaccatcctatcttgacaaagtgattgaccttccacccacacataaaccacctcctctgtatgaagaacgatccccacctttgcctcagaaagacctatttcagcctgaacacttgcctttgcagactcagttcaaagaaagagaagttggcaatcttcagcactctaatggactaaatagcaggagttttgactatgaagatgagaatccagttggggaagatggcattcagcagatgtaccccctttacaatcaaatgtgctaccaagaccggagccctggcaaacatcatcaaaataacgaccctaagagagtctacatcgacccacgagaacattatgtgtgatttttctctttttccaatgggcgttctaacaaatgtttattcttagattggggagagaagctaaggccaatagttattttactgtctctcatataagaacagtcccactctaagggtattggaagtcttaatgaatgacgtaaagccaatagcaaatttc

SEQ ID NO: 22849 - DNA, 3502 bp, Homo sapiens
acgcacctgttctgacctgctgagcaggttcccaggtttctgccgtcgttgttggccacagcgtgggaagcagctctgggggagctcggagctcccgatcacggcttcttgggggtagctacggctgggtgtgtagaacggggccggggctggggctgggtcccctagtggagacccaagtgcgagaggcaagaactctgcagcttcctgccttctgggtcagttccttattcaagtctgcagccggctcccagggagatctcggtggaacttcagaaacgctgggcagtctgcctttcaaccatgcccctgtccctgggagccgagatgtgggggcctgaggcctggctgctgctgctgctactgctggcatcatttacaggccggtgccccgcgggtgagctggagacctcagacgtggtaactgtggtgctgggccaggacgcaaaactgccctgcttctaccgaggggactccggcgagcaagtggggcaagtggcatgggctcgggtggacgcgggcgaaggcgcccaggaactagcgctactgcactccaaatacgggcttcatgtgagcccggcttacgagggccgcgtggagcagccgccgcccccacgcaaccccctggacggctcagtgctcctgcgcaacgcagtgcaggcggatgagggcgagtacgagtgccgggtcagcaccttccccgccggcagcttccaggcgcggctgcggctccgagtgctggtgcctcccctgccctcactgaatcctggtccagcactagaagagggccagggcctgaccctggcagcctcctgcacagctgagggcagcccagcccccagcgtgacctgggacacggaggtcaaaggcacaacgtccagccgttccttcaagcactcccgctctgctgccgtcacctcagagttccacttggtgcctagccgcagcatgaatgggcagccactgacttgtgtggtgtcccatcctggcctgctccaggaccaaaggatcacccacatcctccacgtgtccttccttgctgaggcctctgtgaggggccttgaagaccaaaatctgtggcacattggcagagaaggagctatgctcaagtgcctgagtgaagggcagccccctccctcatacaactggacacggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttgacccccaggaagactctgggaagcaggtggacctagtgtcagcctcggtggtggtggtgggtgtgatcgccgcactcttgttctgccttctggtggtggtggtggtgctcatgtcccgataccatcggcgcaaggcccagcagatgacccagaaatatgaggaggagctgaccctgaccagggagaactccatccggaggctgcattcccatcacacggaccccaggagccagccggaggagagtgtagggctgagagccgagggccaccctgatagtctcaaggacaacagtagctgctctgtgatgagtgaagagcccgagggccgcagttactccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtggaggggtgactgtccgtggaggggtgactgtgtccgtggtgtgtattatgctgtcatatcagagtcaagtgaactgtggtgtatgtgccacgggatttgagtggttgcgtgggcaacactgtcagggtttggcgtgtgtgtcatgtggctgtgtgtgacctctgcctgaaaaagcaggtattttctcagaccccagagcagtattaatgatgcagaggttggaggagagaggtggagactgtggctcagacccaggtgtgcgggcatagctggagctggaatctgcctccggtgtgagggaacctgtctcctaccacttcggagccatgggggcaagtgtgaagcagccagtccctgggtcagccagaggcttgaactgttacagaagccctctgccctctggtggcctctgggcctgctgcatgtacatattttctgtaaatatacatgcgccgggagcttcttgcaggaatactgctccgaatcacttttaatttttttcttttttttttcttgccctttccattagttgtattttttatttatttttatttttatttttttttagagatggagtctcactatgttgctcaggctggccttgaactcctgggctcaagcaatcctcctgcctcagcctccctagtagctgggactttaagtgtacaccactgtgcctgctttgaatcctttacgaagagaaaaaaaaaattaaagaaagcctttagatttatccaatgtttactactgggattgcttaaagtgaggcccctccaacaccagggggttaattcctgtgattgtgaaaggggctacttccaaggcatcttcatgcaggcagccccttgggagggcacctgagagctggtagagtctgaaattagggatgtgagcctcgtggttactgagtaaggtaaaattgcatccaccattgtttgtgataccttagggaattgcttggacctggtgacaagggctcctgttcaatagtggtgttggggagagagagagcagtgattatagaccgagagagtaggagttgaggtgaggtgaaggaggtgctgggggtgagaatgtcgcctttccccctgggttttggatcactaattcaaggctcttctggatgtttctctgggttggggctggagttcaatgaggtttatttttagctggcccacccagatacactcagccagaatacctagatttagtacccaaactcttcttagtctgaaatctgctggatttctggcctaagggagaggctcccatccttcgttccccagccagcctaggacttcgaatgtggagcctgaagatctaagatcctaacatgtacattttatgtaaatatgtgcatatttgtacataaaatgatattctgtttttaaataaacagacaaaacttgttc

SEQ ID NO: 22850 - DNA, 989 bp, Homo sapiens
attccagtccttgctgaggcctctgtgaggggccttgaagaccaaaatctgtggcacattggcagagaaggagctatgctcaagtgcctgagtgaagggcagccccctccctcatacaactggacacggctggatgggcctctgcccagtggggtacgagtggatggggacactttgggctttcccccactgaccactgagcacagcggcatctacgtctgccatgtcagcaatgagttctcctcaagggattctcaggtcactgtggatgttcttgacccccaggaagactctgggaagcaggtggacctagtgtcagcctcggtggtggtggtgggtgtgatcgccgcactcttgttctgccttctggtggtggtggtggtgctcatgtcccgataccatcggcgcaaggcccagcagatgacccagaaatatgaggaggagctgaccctgaccagggagaactccatccggaggctgcattcccatcacacggaccccaggagccagagtgaagagcccgagggccgcagttactccacgctgaccacggtgagggagatagaaacacagactgaactgctgtctccaggctctgggcgggccgaggaggaggaagatcaggatgaaggcatcaaacaggccatgaaccattttgttcaggagaatgggaccctacgggccaagcccacgggcaatggcatctacatcaatgggcggggacacctggtctgacccaggcctgcctcccttccctaggcctggctccttctgttgacatgggagattttagctcatcttgggggcctccttaaacacccccatttcttgcggaagatgctccccatcccactgactgcttgacctttacctccaacccttctgttcatcgggagggctccaccaattgagtctctcccaccatgcatgcaggtcactgtgtgtgtgcatgtgtgcctgtgtgagtgttgactgactgtgtgtgtgtg

SEQ ID NO: 22851 - DNA, 2960 bp, Homo sapiens
gcgcgcggctccgctgggaagcgagacccgggtggcgggacaagacttgcttcccggccacgcgcgctcggccggccgtggggcggggcataggccgtgacgtgatgtcgcgtatcgagtctccgcccccttcccgcctccccgtatataagacttcgccgagcgctctcactcgcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatgggaagtgttgcagacacagtggcaagggttcttcggggatgtctggaaaacatgccggaagctgattgcattcccaaagagcagctgagcacatcatttcagtgggtcaccaaatgggttgattactctaacaaatatggctttgggtaccagctctcagaccacaccgtcggtgtccttttcaacaatggtgctcacatgagcctccttccagacaaaaaaacagttcactattacgcagagcttggccaatgctcagttttcccagcaacagatgctcctgagcaatttattagtcaagtgacggtgctgaaatacttttctcattacatggaggagaacctcatggatggtggagatctgcctagtgttactgatattcgaagacctcggctctacctccttcagtggctaaaatctgataaggccctaatgatgctctttaatgatggcacctttcaggtgaatttctaccatgatcatacaaaaatcatcatctgtagccaaaatgaagaataccttctcacctacatcaatgaggataggatatctacaactttcaggctgacaactctgctgatgtctggctgttcatcagaattaaaaaatcgaatggaatatgccctgaacatgctcttacaaagatgtaactgaaagacttttcgaatggaccctatgggactcctcttttccactgtgagatctacagggaagccaaaagaatgatctagagtatgttgaagaagatggacatgtggtggtacgaaaacaattcccctgtggcctgctggactggttggaaccagaacaggctaaggcatacagttcttgactttggacaatccaagagtgaaccagaatgcagttttccttgagatacctgttttaaaaggtttttcagacaattttgcagaaaggtgcattgattcttaaattctctctgttgagagcatttcagccagaggactttggaactgtgaatatacttcctgaaggggagggagaagggaggaagctcccatgttgtttaaaggctgtaattggagcagcttttggctgcgtaactgtgaactatggccatatataattttttttcattaatttttgaagatacttgtggctggaaaagtgcattccttgttaataaactttttatttattacagcccaaagagcagtatttattatcaaaatgtctttttttttatgttgaccattttaaaccgttggcaataaagagtatgaaaacgcagaaa

SEQ ID NO: 22852 - DNA, 1489 bp, Homo sapiens
acaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgactttttttgcagggcttcactccggacagactgtcttctagctgttgtcatacagttccagatttccacttatcaagcccagctaagaatttctttaagaaagcagctgctgctctttttggtggcaaaaaagacaaagcaagatatattgacacacataatagagtgtctaaagaagatgaagacatctacaagcttaggcatgatttgaaaaagacttcaataactcagcaacccagcaaacacaggacagatgaggagctccagccacctaccaccacagttgccaggtctggaacacccgcagtagaaaacaagcagcagattggggatgctattcggatgatagtcagagggactcttggcagctgtagcagcagcagtgaatgccttgaagacagtaccatggga

SEQ ID NO: 22853 - DNA, 1267 bp, Homo sapiens
gcacaagtggaccggggtgttgggtgctagtcggcaccagaggcaagggtgcgaggaccacggccggctcggacgtgtgaccgcgcctagggggtggcagcgggcagtgcggggcggcaaggcgaccatggagcttttgcggactatcacctaccagccagccgccagcaccaaaatgtgcgagcaggcgctgggcaagggttgcggagcggactcgaagaagaagcggccgccgcagccccccgaggaatcgcagccacctcagtcccaggcgcaagtgcccccggcggcccctcaccaccatcaccaccattcgcactcggggccggagatctcgcggattatcgtcgaccccacgactgggaagcgctactgccggggcaaagtgctgggaaagggtggctttgcaaaatgttacgagatgacagatttgacaaataacaaagtctacgccgcaaaaattattcctcacagcagagtagctaaacctcatcaaagggaaaagattgacaaagaaatagagcttcacagaattcttcatcataagcatgtagtgcagttttaccactacttcgaggacaaagaaaacatttacattctcttggaatactgcagtagaaggtcaatggctcatattttgaaagcaagaaaggtgttgacagagccagaagttcgatactacctcaggcagattgtgtctggactgaaataccttcatgaacaagaaatcttgcacagagatctcaaactagggaacttttttattaatgaagccatggaactaaaagttggggacttcggtctggcagccaggctagaacccttggaacacagaaggagaacgatatgtggtaccccaaattatctctctcctgaagtcctcaacaaacaaggacatggctgtgaatcagacatttgggccctgggctgtgtaatgtatacaatgttactagggaggcccccatttgaaactacaaatctcaaagaaacttataggtgcataagggaagcaaggtatacaatgccgtcctcattgctggctcctgccaagcacttaattgctagtatgttgtccaaaaacccagaggatcgtcccagtttggatgacatcattcgacatgacttttttttgcagggcttcactccggacagactgtcttctagctgttgtcatacagttccagatttccacttatcaagcccagctaagaatttctttaaaagagcagctgagcacatcatttcagtgggtcaccaaatgggttga

SEQ ID NO: 22854 - DNA, 2429 bp, Homo sapiens
gtagatcttttgcgagcaggagaagttcctaaaccttttccaacacattataaagatttgtgggataacaagcatgttaaaatgccttgttcagaacaaaatttgtacccagtggaagatgagaatggtgagcgaactgcggggagccggtgggagctcattcagactgcacttctcaacaaatttacacgaccccaaaacttgaaggatgctattctgaaatacaatgtggcatattctaagaaatgggactttacagctttgatcgatttctgggataaggtacttgaagaagcagaagctcaacatttatatcagtccatcttgcctgatatggtgaaaattgcactctgtctgccaaatatttgcacccagccaataccactcctgaaacagaagatgaatcattccatcacaatgtcgcaggaacagattgccagtcttttagctaatgctttcttctgcacatttccacgacgaaatgctaagatgaaatcggagtattctagttacccagacattaacttcaatcgattgtttgagggacgttcatcaaggaaaccggagaaacttaaaacgctcttctgctactttagaagagtcacagagaaaaaacctactgggttggtgacatttacaagacagagtcttgaagattttccagaatgggaaagatgtgaaaaacccttgacacgattgcatgtcacttacgaaggtaccatagaagaaaatggccaaggcatgctacaggtggattttgcaaatcgttttgttggaggtggtgtaaccagtgcaggacttgtgcaagaagaaatccgctttttaatcaatcctgagttgattatttcacggctcttcactgaggtgctggatcacaatgaatgtctaattatcacaggtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaa

SEQ ID NO: 22855 - DNA, 1639 bp, Homo sapiens
gtactgagcagtacagtgaatacacaggctatgctgagacatatcgttggtcccggagccacgaagatgggagtgaaagggacgactggcagcggcgctgcactgagatcgttgccatcgatgctcttcacttcagacgctacctcgatcagtttgtgcctgagaaaatgagacgcgagctgaacaaggcttactgtggatttctccgtcctggagtttcttcagagaatctttctgcagtggccacaggaaactggggctgtggtgcctttgggggtgatgccaggttaaaagccttaatacagatattggcagctgctgcagctgagcgagatgtggtttatttcacctttggggactcagaattgatgagagacatttacagcatgcacattttccttactgaaaggaaactcactgttggagatgtgtataagctgttgctacgatactacaatgaagaatgcagaaactgttccacccctggaccagacatcaagctttatccattcatataccatgctgtcgagtcctgtgcagagaccgctgaccattcagggcaaaggacagggacctgaggagccgagcgaatagcatctcctcccacctcccaccagagacgtcctgtttgagctgtcaggtgtaatatatgaattgacttaagttaatataaatgtgtacataatccacatttgtagtcaaggacgcaatctcttccacacatgtgcagttgtcagttggtacatctaaactccctccatcctgactcacgtggacttagatatgttttgtttctattttcttctatttcagtttttcattctttgatgtttatttcttttgtccatcagatctcttgtgaaatcccatggaaggttgtgctcagcctgtcgggtctctttcttcctgcccatatattataccagttgcttctgcagcccgcagatgccagcgatgccaggaaacaagttgaaatccaggaatctctttaactgattttgctaaaaatctccctgtgagccttccactcaactcttaatatgcttgcattgtttaagtttttaaattctgaaaattaataattagggtttttttcatatgtgttgcataatgcaaacctcctaggttaaaatagtttctttatttaagatagaataatttccagaaattgtacttttgaggtatcatttttatctgtaatggtttgtctgtcttttttcctctgatcagtatttttttataccagttttggagactggctgagatgaaaggaaatgtggaataaaaggaggttttcctgatgtggtgtaaagaaaacagattcaagagaattgaagattttttttgtttcttggtacttttttctttttaaattaggactaatgtttcttttgtggtgcttgaggcatattcatataaccaaagtttgagaactgggaacttcatgctgatttgtacatattgaagtttctctggtattcaaaggttatatagtgaatgaattttcattaataaatcactttgtcagaaactcccatatcatctatattttatatatgtatatataaacgtatgctctttaagtgtgtctatatgtgagcacataaaatctaaataaaattggactggtgggaaacaa

SEQ ID NO: 22856 - DNA, 570 bp, Homo sapiens
gtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggtgtgtacatactggggcagcatgggcattcagcccccaccctgaagctcccaggagggcctcgtctcagagagcaaagcaaacctcccccagcttgccctctcccacatgtgcagatcaagcgtatggtgcccatgttatttcagcaacacctcctggactcagcatcatctgttgcatgatatttggtattttgtttttccaggtgcttggaatgtagcctttaaagtt

SEQ ID NO: 22857 - DNA, 477 bp, Homo sapiens
gaacggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacagaacctccaataccatgtggaatagaagtgatgggaagatag

SEQ ID NO: 22858 - DNA, 553 bp, Homo sapiens
ggcggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacagaacctccaataccatgtggaatagaagtgatgggaagatagcttcgtcttattcctaatcttaggcaaaggccaggatggaattggtagcaaggcagagaagactctgggtgactttgcag

SEQ ID NO: 22859 - DNA, 3958 bp, Homo sapiens
cggtggccggtgcggcgtgttcggtggcggctctggccgctcaggcgcctgcggctgggtgagcgcacgcgaggcggcgaggcggcagcgtgtttctaggtcgtggcgtcgggcttccggagctttggcggcagctaggggaggatggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaaggatagtaagcttgaaaaagccctaaaggctcagaacgacctgatctggaacatcaaggacgagctaaagaaagtgtgttcaactaatgacctgaaggagctactcatcttcaacaagcagcaagtgccttctggggagtcggcgatcttggaccgagtagctgatggcatggtgttcggtgccctccttccctgcgaggaatgctcgggtcagctggtcttcaagagcgatgcctattactgcactggggacgtcactgcctggaccaagtgtatggtcaagacacagacacccaaccggaaggagtgggtaaccccaaaggaattccgagaaatctcttacctcaagaaattgaaggttaaaaaacaggaccgtatattccccccagaaaccagcgcctccgtggcggccacgcctccgccctccacagcctcggctcctgctgctgtgaactcctctgcttcagcagataagccattatccaacatgaagatcctgactctcgggaagctgtcccggaacaaggatgaagtgaaggccatgattgagaaactcggggggaagttgacggggacggccaacaaggcttccctgtgcatcagcaccaaaaaggaggtggaaaagatgaataagaagatggaggaagtaaaggaagccaacatccgagttgtgtctgaggacttcctccaggacgtctccgcctccaccaagagccttcaggagttgttcttagcgcacatcttgtccccttggggggcagaggtgaaggcagagcctgttgaagttgtggccccaagagggaagtcaggggctgcgctctccaaaaaaagcaagggccaggtcaaggaggaaggtatcaacaaatctgaaaagagaatgaaattaactcttaaaggaggagcagctgtggatcctgattctggactggaacactctgcgcatgtcctggagaaaggtgggaaggtcttcagtgccacccttggcctggtggacatcgttaaaggaaccaactcctactacaagctgcagcttctggaggacgacaaggaaaacaggtattggatattcaggtcctggggccgtgtgggtacggtgatcggtagcaacaaactggaacagatgccgtccaaggaggatgccattgagcacttcatgaaattatatgaagaaaaaaccgggaacgcttggcactccaaaaatttcacgaagtatcccaaaaagttctaccccctggagattgactatggccaggatgaagaggcagtgaagaagctgacagtaaatcctggcaccaagtccaagctccccaagccagttcaggacctcatcaagatgatctttgatgtggaaagtatgaagaaagccatggtggagtatgagatcgaccttcagaagatgcccttggggaagctgagcaaaaggcagatccaggccgcatactccatcctcagtgaggtccagcaggcggtgtctcagggcagcagcgactctcagatcctggatctctcaaatcgcttttacaccctgatcccccacgactttgggatgaagaagcctccgctcctgaacaatgcagacagtgtgcaggccaaggtggaaatgcttgacaacctgctggacatcgaggtggcctacagtctgctcaggggagggtctgatgatagcagcaaggatcccatcgatgtcaactatgagaagctcaaaactgacattaaggtggttgacagagattctgaagaagccgagatcatcaggaagtatgttaagaacactcatgcaaccacacacaatgcgtatgacttggaagtcatcgatatctttaagatagagcgtgaaggcgaatgccagcgttacaagccctttaagcagcttcataaccgaagattgctgtggcacgggtccaggaccaccaactttgctgggatcctgtcccagggtcttcggatagccccgcctgaagcgcccgtgacaggctacatgtttggtaaagggatctatttcgctgacatggtctccaagagtgccaactactgccatacgtctcagggagacccaataggcttaatcctgttgggagaagttgcccttggaaacatgtatgaactgaagcacgcttcacatatcagcaagttacccaagggcaagcacagtgtcaaaggtttgggcaaaactacccctgatccttcagctaacattagtctggatggtgtagacgttcctcttgggaccgggatttcatctggtgtgaatgacacctctctactatataacgagtacattgtctatgatattgctcaggtaaatctgaagtatctgctgaaactgaaattcaattttaagacctccctgtggtaattgggagaggtagccgagtcacacccggtggctctggtatgaattcacccgaagcgcttctgcaccaactcacctggccgctaagttgctgatgggtagtacctgtactaaaccacctcagaaaggattttacagaaacgtgttaaaggttttctctaacttctcaagtcccttgttttgtgttgtgtctgtggggaggggttgttttggggttgtttttgttttttcttgccaggtagataaaactgacatagagaaaaggctggagagagattctgttgcatagactagtcctatggaaaaaaccaagcttcgttagaatgtctgccttactggtttccccagggaaggaaaaatacacttccacccttttttctaagtgttcgtctttagttttgattttggaaagatgttaagcatttatttttagttaaaaataaaaactaatttcatactatttagattttcttttttatcttgcacttattgtcccctttttagttttttttgtttgcctcttgtggtgaggggtgtgggaagaccaaaggaaggaacgctaacaatttctcatacttagaaacaaaaagagctttccttctccaggaatactgaacatgggagctcttgaaatatgtagtattaaaagttgcatttgaaattcttgactttcttatgggcacttttgtcttccaaattaaaactctaccacaaatatacttacccaagggctaatagtaatactcgattaaaaatgcagatgccttctcta

SEQ ID NO: 22860 - DNA, 750 bp, Homo sapiens
atggcggagtcttcggataagctctatcgagtcgagtacgccaagagcgggcgcgcctcttgcaagaaatgcagcgagagcatccccaaggactcgctccggatggccatcatggtgcagtcgcccatgtttgatggaaaagtcccacactggtaccacttctcctgcttctggaaggtgggccactccatccggcaccctgacgttgaggtggatgggttctctgagcttcggtgggatgaccagcagaaagtcaagaagacagcggaagctggaggagtgacaggcaaaggccaggatggaattggtagcaaggcagagaagactctgggtgactttgcagcagagtatgccaagtccaacagaagtacgtgcaaggggtgtatggagaagatagaaaagggccaggtgcgcctgtccaagaagatggtggacccggagaagccacagctaggcatgattgaccgctggtaccatccaggctgctttgtcaagaacagggaggagctgggtttccggcccgagtacagtgcgagtcagctcaagggcttcagcctccttgctacagaggataaagaagccctgaagaagcagctcccaggagtcaagagtgaaggaaagagaaaaggcgatgaggtggatggagtggatgaagtggcgaagaagaaatctaaaaaagaaaaagacaagaaaaaaaaaaaaaaaaaaaaaaaggaaagaaaaaaaaagaagaaaaaaagaaaaaaaaag

SEQ ID NO: 22861 - DNA, 6769 bp, Homo sapiens
ctccctgttcccggcagagccgcttccccctcctccctgtgctgtctgcaccgaggagagcggcctgccgggtgagtaggtccggtgcctctgggccctcggggtcccctctcctgcaggctcgaggtgggcggggagaagggggacgggcgcggacccgggtcccagggccaggcctcccttgtgagtagactatgcaaagaaaaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcggtaggtgtcaatgcctcatcattggggctactctgtggaatttggtgagctgacatcagtagattcttccactgatagcatttgttgttgtggggaagggatcatttgtgactgtgatttagaggtcacaaatgatgacccaggtcacaaagtattttggaaagagtggtattttttacttttccttcgtatcttttgttgctgatgcattttacattgatgaaaagtgtgagcagtaagaactacggttcactgtttttctcctttatgtgtttctgtgtcctatccgcagagaacacgttgaggctttttttttttttttttgccttacttatctcaacaaaattattaccaacagcactgaaccgtcctcatcccttaattaaaagggcattttcccaaatttaagaaagttggtcttttctctttcatccctttgtttcctatagcctgctagtgaatgaattaggtatcatttggcaggtgaagtgcataacatcttaagatcctcttcatccataggagttctatgtgtaactcccatgtctcttttcagatgtacaaaaacattgcatatataattcttatattgccccctctactcctcagtcactaatgaagatttctggctttagttctctccaaaagaggaaaagaaatttagtaaaaattatggagagatacttagcggggtggcttgattttgcttggtctattaaatatgtggctcttgatctttatctttcaacatatgtagcatgatccttgctgaggagtcaattccaatagacttggtttctaggatgcaaaggctctagaaatcatcttttctttgttctggagagaacataggcaaaacttggggtaaatgttgaacatagacaattactggggataaaaatagagaaatgaatccctaccaagaagccttttggggcaatcaggaaagtgatgatcagtatagtcccttcattagcaaagtcttaaaaaatctataatttccatttgctcctaaagctggcttctctgcaatccccacccactacttctacttaaattactttcattaagatcatcgctgtgctcttactttccaaatctagtgagtattctcttttcagtcctgtgacagactctgctacttgcctacccaacatctatacacatctttcttactaaaacatctaagacacccactatcctcccaaggaatatggtcccaaggtcttagccagactcatcatcagctcaagttcaggcagttctctctttatttatttatttatttttctgagacggagtcttgctctgtcactcaggctggagtgcagtggcaccatcttggctcactgcaacctccgcctccgagattcaaacagttctcctgcctcagcctcccaggtagctgggattacaggcatgtgccaccacgtgcagttaatttttgtattttttttagtagagacgaggtttcatcatgttggccaggctgatctccagctactcgtgatccgtccacctcagcctcccaaagtgttgggcttacaggtatgagccaccatgcccagcaggcagttctctcttaaagcttaaaggcaagatactgcccccaacatactcattatatagtgatataaaaaggagcgggaaaactgcaatgaaaactctcatgttgaaaggggagaagcaaaacacacaacagccactggctcacaccacttatctacatgctgccgaacaggtatagagaggactccctattccatgttgtaaaacctttattttgcactctgggaaaatcttccttatatattgtggcccttggctatttccaggttcattgcctatcagggagccatggattttctcacaggctagaatgtgctcaggctgttgcaaccaggcttgtggtttcttcagcaatacagttcctttaaaaattcagtgggcacgaggcctaatttcttctggttaagtttatgtctttataacctaaccacagatcttgtctccatatagtctttcaactcaagattttggtctcttacctgctgtctgtgtgctctgcccttctccctatcccttagcttaacagccactgccttgaggcaattcagacatgactcataatgtgacctgcaccaattgactcatctctgtaggctagagagaactcttaacagaaggtgccagacaagcccaggagacaccaatcttgctaccactgaagctgttgttatttggagtacaaaagctcttagctttttcagccgtgcaatattccaaattataggactctcagtcaatttagatggccacccacaggcaaaggagacagaacttctgttaacaaacctttattttcttttttctatttatgtttgcattccaaccagttctgaataaatctcttgcttgtaggacttggttgagtgcagcaagaaggcatctacacatgcagtttcttactgggttgattcatttgttccacaggtatttattaagcacattctatgaatcaggccctgtgctaggggtactagaaatagagtgtaaataaaaaaccatagagttcttgcccttacaatttataatctcacgagttcacctgttgcccattctttatcttctctcttttttcctctacgatgtcccccttggtgatggcacctgttcccatggcctcaactcctacctcaatgatgacgacttaggaatttctaactcttaactccctacctctctcctgacctgcaggttcatatgtctcactctctttttgacatctttacccagatgtcccataggtaactcaaattgatcccttttcttggtcatgattttccctaagaaatatgccctttgtttgctgattctccctaacctggttagtatcatcaccatctacctaccaggtttcctaaggctgaaacattatcatcctccattcctccttttccctcacccttatacccaggcattcacccagtcctagtgattcactctcatgaagatctcagcccagtttcacctctctattcctactgccttagttaatcttccttcagacctagactattactaggtcctctccttgccacaaaacacacccctacctaatctatcctttaccaccagaattatcacgctaaaaattacattcttgcttaatatctgtattcccagttgcctacgggataaaagcccaaactccttagcagagaatataaggccctagctcccacattatttcagcagtcatcacccactatgttcctcaagactgcagccattaactttttagagttccctaaacatgctgtttactttcatgcctctatcccgttgtctgtggaatgacttccctccttgcccttttcagtgctacaaacccctattctttaagacatagtacaaatggcatctcctggttggcatctttcctgcaggcctacaggcctagtaagtatcttcctcctctgtgctcctgcatacctccattcctttgttatgacatctataactttaataagtactaaaatctgtagtcctacaaaactcaggcatagaactcatttcctttatggctctataatggaactttacccaactctcacgttccccatgaccacagatgtggaaaatttgaatcttgacagttcaaggtgaactcagtcattttcagagttttcatagtcccttcaagattgaaactcagttcctgcaatgtttgccccttttctcctcttttgtctatgctgggagaggcattgtggggagggttgtctggcttatggctcccattgtcctctgcttgataaaccacctgagctttggtcattagcagtctcctgtgcctttcacactcaggtagtgtctgcacaggccactctatgtcttttccatgctgaagaaattcctttccaggccatgtctgtgttcctcctgccacacaggaaatttttgagcatgttcatcctccaagctgaatgcagggtcttgggtagtggtcctcacctgctccagagacttctccagccattgccactctccactcaggtgatgaagctggatgagggactgcacccaccagagtcaggccagggtcctgtctgctctgtgagtccctccaattgttcttattccgagatttccattgttctgccccctcttgactcccagggctctcaagggagtgggggtagtgaagggagccctttcccaagctcccccaagagctctagtcacatcacttctgatacttcttttcccaccagctggaagaaagaactttcatttgtcttgaaatgagaaaaatgttcttagaatattttgtattactctctgctctgtcatttatggtaaacaaaataaaataataaaaaaaaacaaccc

SEQ ID NO: 22862 - DNA, 3040 bp, Homo sapiens
gagtaggtccggtgcctctgggccctcggggtcccctctcctgcaggctcgaggtgggcggggagaagggggacgggcgcggacccgggtcccagggccaggcctcccttgtgagtagactatgcaaagaaaaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttag

SEQ ID NO: 22863 - DNA, 3796 bp, Homo sapiens
attcctggattacctcctcaaagggctctaacaactcgcattgctctcagcgtgtgagagggtcctttgctctgaagggtcttctaaaatatttgttcaatcgttacttagcaggggctgggagtaacggattttattttattttattttattttttgagacggagtctcgctctgtcgcccaggctggagtgcagtcgcgcaatctcggctcacggatttgctcttttaaaggacatacccttttatgtttaaatgaaggaactcattgatgcaccgaggcgaaaggaacctttaattaagtgcgtcttctatgcggagtgatcgcttttgtcacttgttcgaggggtgagagctcccgtcagttgtccctgtttctgtgagccgtctacgaagcccgggcttggcctgggcgacgctgagcggctttaaccggcggcgtccagccggctccgccagcgctgccgccgccctcgaggctccctctgactgaaggcgcgctgagcatcgcggcattaggggctcctggtccctcaaacatccagggaagccattttcagggactaggtactgacccccgcgagccgccacagccacagcccgcgctccgggccgaacgcccgagctcaagagctcccgagcttccgtcgggcggcggcctcacagctgggggccctgaggcggaaggcgcagccgctcagctgcggaccgggggcgtggcgagggcgcacaggttctgtttttcgccggcccggggccgctttcggtttcgtttcccgccggcgtctccaccctgcgagagccgcccgccagccagcgtccgccgccgtccgcgtcgcgccacccgcggtccgacgggagcaggcccagcggccatggcccaggccggcgtcgtcggtgaggtcacccaggtgctgtgcgcggccgggggcgccctggagttgcccgagctgcggcgccgcttgcggatgggcttgagcgccgacgcgctggagcggctgctgcggcagcgtgggcgcttcgtggtggcggtgcgggcgggcggcgcagccgcggccccggagcgcgtggtgctggccgcctcgccgctgcgcctgtgtcgcgcgcaccagggctccaagccgggctgcgtggggctctgcgcgcagctccacctctgcaggttcatggtctacggcgcctgcaagttcctgagagccgggaagaactgtaggaatagtcacagcttgacaaccgaacacaacctgagtgtgctgagaactcatggcgttgaccacctgagctataatgagctatgccaactcttgtttcagaacgacccctggcttttgccagaaatttgccaacattacaacaaaggagatggaccccacggctcttgtgcctttcaaaagcagtgcatcaagctccatatctgccagtattttttacagggggaatgcaagtttggcactagctgtaagagatcccatgatttctctaattctgagaatctggaaaaattggagaagttgggtatgagctcagacctggtgagcaggctgcctaccatttatagaaatgcacatgacatcaagaataagagctctgcccccagcagagtgcctcctctttttgtcccacaggggacttctgaaagaaaagacagttcaggttctgtgtccccaaacactcttagccaggaggagggtgatcagatctgtttgtaccatatccggaaaagttgtagctttcaagataagtgccatagagttcatttccatttgccgtatcgatggcaattcttggatagaggcaaatgggaggatttggacaacatggaacttattgaagaggcatattgcaatcccaaaatagaaaggatcctgtgctctgagtcagccagtacctttcactctcattgtctgaactttaacgccatgacttacggtgctacccaggctcgccgcctctccacggcctcctctgtcaccaaacctccacacttcatcctcaccactgactggatttggtactggagtgatgagtttggttcttggcaggaatatggaagacagggcacggtgcaccctgtgaccactgtcagcagtagcgacgtggagaaggcctacctggcctactgtacaccggggtctgacggccaggcagccaccttgaagttccaggccggaaagcacaactacgagttagatttcaaagccttcgttcagaaaaacctggtctatggcacaactaaaaaggtttgccgcagacccaaatacgtgtctccccaggatgtgacgaccatgcaaacctgcaataccaagtttccaggcccgaagagcatcccagactattgggactcctctgccctgccagacccaggctttcagaagatcacccttagttcttcctcggaagagtatcagaaggtctggaacctctttaaccgcacgctgcctttctactttgttcagaagattgagcgagtacagaacctggccctctgggaagtctaccagtggcaaaaaggacagatgcagaagcagaacggagggaaggccgtggacgagcggcagctgttccacggcaccagcgccatttttgtggacgccatctgccagcagaactttgactggcgggtctgtggtgttcatggcacttcctacggcaaggggagctactttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaacaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccgaagtgga

SEQ ID NO: 22864 - DNA, 1127 bp, Homo sapiens
ctttgcccgagatgctgcatattcccaccactacagcaaatccgacacgcagacccacacgatgttcctggcccgggtgctggtgggcgagttcgtcaggggcaatgcctcctttgtccgtccgccggccaaggagggctggagcaacgccttctatgatagctgcgtgaacagtgtgtccgacccctccatctttgtgatctttgagaaaaccaggtctacccagagtatgtcatccagtacaccacctcctccaagccctcggtcacaccctccatcctgctggccttgggctccctgttcagcagccgacagtgagcgcacaggagtgttccaggcctttcacctgctctgccttgaaatggctatttgggcctttccttttctttttaaacagaaacttttaatgaactgttctcttaacattgacctctcaatgaagttatgttcttaatctcttgctaataatgatttttacttttaagtcacttttgggttcactagtggattaaccagaagtgattgtagttgagtccagttttgctttttaataatgtgttgaagttttagtttttactctttgttgactttgctgcttattggcaccagggacagagtttctagatacaattttatggattggttttaatttttatgagtttgtctctgcagtgattcggtttctcagagtctcatggcatcatagtttttccagaatgacacagtagccaccggtggatgacagcccacgggcggcacagtcacttctgcctgttgctctgacaccaacccaggcagctctgctgtggcttctcctgggctctggcattagttggtctgtgtcacattgtcagaacaggtggctgctgtgtggtgccatcgagtccctgctggttccccttgtcctgggagggtcacccattgcccaaggaagtgcatccacctggcaggtgacctggaggagtagcttccccgaggacccccaggcttggcctgtgattgcgcaaacccacatttcctaagcacactggacacccttcgagtgtgggttttaacatccctgtgagattgaatacttgtgccacacatgtcacaaaagagtatggaaataaaagaaaatttatccg

SEQ ID NO: 22865 - DNA, 5099 bp, Homo sapiens
aaagttagcggcccggagttggcgcggcccctgcagtccggcggagagcggagctgaggatggctgtgcccggctccttcccgctgctggtcgagggctcctggggccccgaccccccgaagaacttgaacaccaagttgcagatgtacttccagagcccgaagaggtcgggaggcggcgagtgtgaggtccgccaggatcccaggagcccatcccgcttcctggtgttcttctacccggaggacgttcggcagaaggttctggagagaaaaaatcatgagttggtatggcaaggaaaaggaacattcaagttaactgtccagttacctgcaaccccagatgaaatcgatcatgtctttgaagaggaacttctaacaaaagaatccaagaccaaagaagatgttaaagaaccagatgtgtcagaagaattggatacaaaactccctcttgatggtggattagacaaaatggaagatatcccagaggaatgtgaaaatatttcctctttggtggcatttgaaaacctcaaggcaaatgtgactgacataatgctaatcttgttagtggagaacataagtggcctgtctaatgatgactttcaagtggaaataataagagattttgatgttgctgttgttacctttcaaaagcacatagatactataagatttgttgatgattgtaccaagcaccattcaattaaacaacttcagctttctccaagacttctggaagtgacaaacacaatcagggttgaaaacctgccacctggtgctgatgactacagtttaaaacttttctttgaaaatccctataatggagggggaagagttgccaatgttgaatattttcctgaagagagttcagctctgattgaattttttgacagaaaagtgttagacaccatcatggccacaaaactcgacttcaataaaatgccactttctgtgttcccatactatgcctcattgggcacagccttgtatggaaaggagaagcctctgatcaagcttccagcaccatttgaagagtcactagatcttcccttatggaagttcttacagaaaaagaatcacctcattgaggagataaacgatgaaatgaggcgttgtcactgtgagctcacgtggtcccaactcagtggtaaagttaccatcagaccagcagccaccttagtcaatgaaggaagaccgagaatcaagacctggcaggcagatacttccacaacactctctagcatcaggtctaaatataaagtcaacccaattaaagtggatccaacaatgtgggacaccataaaaaatgatgtgaaagatgacaggattttgattgagtttgatacacttaaggagatggtaatcttagcagggaaatcagaggatgtccaaagcattgaggtacaagtcagggagttaatagaaagcactactcaaaaaattaaaagggaagagcaaagtttgaaggaaaaaatgatcatttctccaggcaggtattttcttttgtgtcacagcagtctactggaccatttactcacggagtgcccagagatagagatttgttacgatagagtcactcaacacttgtgcttgaaaggacctagtgcagatgtgtataaagcaaagtgtgaaatccaggaaaaggtgtacaccatggctcagaaaaacattcaggtttctcctgagatttttcagtttttgcaacaggtaaactggaaagaattctctaagtgtcttttcatagcacagaagattcttgcactttatgagctagagggtacaactgttctcttaaccagctgttcttctgaagccctgttagaagcagaaaagcaaatgctcagtgccttaaattataagcgcattgaagttgagaacaaagaagttcttcatggcaagaaatggaaagggctcactcacaatttgcttaagaaacaaaattcctccccaaacactgtaatcatcaatgagttaacttcagaaaccacagctgaagtcatcattacaggctgtgtaaaagaagtaaatgaaacctataaattgctttttaacttcgttgaacaaaacatgaaaatagagagactggttgaagtaaagccttccttagttattgactatttaaagacagaaaagaagctattctggccaaagataaagaaggtaaatgtgcaggtaagtttcaatcctgagaacaaacaaaaaggcattttactaactggctcaaagaccgaagtactgaaggcagtggacattgtcaagcaagtctgggattcagtctgtgttaaaagtgtccatactgataagccaggagccaagcagttcttccaggataaagcacggttttatcaaagtgagatcaaacggttgtttggttgttacattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatatgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaaggtgaatgtgatgattcgtgcctgtagtcccagctattgggaggctgaggtggaaggattgcatgagcccaggagtttgacgccagtctgggtaacatag

SEQ ID NO: 22866 - DNA, 4636 bp, Homo sapiens
atgtatctgagaagactgttgaggcctttgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatatgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgaagtcagtctttcttcagcttccctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtc

SEQ ID NO: 22867 - DNA, 7464 bp, Homo sapiens
aaagttagcggcccggagttggcgcggcccctgcagtccggcggagagcggagctgaggatggctgtgcccggctccttcccgctgctggtcgagggctcctggggccccgaccccccgaagaacttgaacaccaagttgcagatgtacttccagagcccgaagaggtcgggaggcggcgagtgtgaggtccgccaggatcccaggagcccatcccgcttcctggtgttcttctacccggaggacgttcggcagaaggttctggagagaaaaaatcatgagttggtatggcaaggaaaaggaacattcaagttaactgtccagttacctgcaaccccagatgaaatcgatcatgtctttgaagaggaacttctaacaaaagaatccaagaccaaagaagatgttaaagaaccagatactataagatttgttgatgattgtaccaagcaccattcaattaaacaacttcagctttctccaagacttctggaagtgacaaacacaatcagggttgaaaacctgccacctggtgctgatgactacagtttaaaacttttctttgaaaatccctataatggagggggaagagttgccaatgttgaatattttcctgaagagagttcagctctgattgaattttttgacagaaaagtgttagacaccatcatggccacaaaactcgacttcaataaaatgccactttctgtgttcccatactatgcctcattgggcacagccttgtatggaaaggagaagcctctgatcaagcttccagcaccatttgaagagtcactagatcttcccttatggaagttcttacagaaaaagaatcacctcattgaggagataaacgatgaaatgaggcgttgtcactgtgagctcacgtggtcccaactcagtggtaaagttaccatcagaccagcagccaccttagtcaatgaaggaagaccgagaatcaagacctggcaggcagatacttccacaacactctctagcatcaggtctaaatataaagtcaacccaattaaagtggatccaacaatgtgggacaccataaaaaatgatgtgaaagatgacaggattttgattgagtttgatacacttaaggagatggtaatcttagcagggaaatcagaggatgtccaaagcattgaggtacaagtcagggagttaatagaaagcactactcaaaaaattaaaagggaagagcaaagtttgaaggaaaaaatgatcatttctccaggcaggtattttcttttgtgtcacagcagtctactggaccatttactcacggagtgcccagagatagagatttgttacgatagagtcactcaacacttgtgcttgaaaggacctagtgcagatgtgtataaagcaaagtgtgaaatccaggaaaaggtgtacaccatggctcagaaaaacattcaggtttctcctgagatttttcagtttttgcaacaggtaaactggaaagaattctctaagtgtcttttcatagcacagaagattcttgcactttatgagctagagggtacaactgttctcttaaccagctgttcttctgaagccctgttagaagcagaaaagcaaatgctcagtgccttaaattataagcgcattgaagttgagaacaaagaagttcttcatggcaagaaatggaaagggctcactcacaatttgcttaagaaacaaaattcctccccaaacactgtaatcatcaatgagttaacttcagaaaccacagctgaagtcatcattacaggctgtgtaaaagaagtaaatgaaacctataaattgctttttaacttcgttgaacaaaacatgaaaatagagagactggttgaagtaaagccttccttagttattgactatttaaagacagaaaagaagctattctggccaaagataaagaaggtaaatgtgcaggtaagtttcaatcctgagaacaaacaaaaaggcattttactaactggctcaaagaccgaagtactgaaggcagtggacattgtcaagcaagtctgggattcagtctgtgttaaaagtgtccatactgataagccaggagccaagcagttcttccaggataaagcacggttttatcaaagtgagatcaaacggttgtttggttgttacattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagtaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatatgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgaagtcagtctttcttcagcttccctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtc

SEQ ID NO: 22868 - DNA, 7915 bp, Homo sapiens
ccgtggagcacaggtgaactgaggccgccttcccggggcgccgctggccagccccaaagggttactttggccttggctgtgggccgaatgcgaaggtggggaggtgggcgggggatgactctgccattcctgggtccgctgtgttaggctgaaggcaaaaggaaaccaaggcctgggagttttccaggaaacgaaagcgaaagagtcaaagttagcggcccggagttggcgcggcccctgcagtccggcggagagcggagctgaggatggctgtgcccggctccttcccgctgctggtcgagggctcctggggccccgaccccccgaagaacttgaacaccaagttgcagatgtacttccagagcccgaagaggtcgggaggcggcgagtgtgaggtccgccaggatcccaggagcccatcccgcttcctggtgttcttctacccggaggacgttcggcagaaggttctggagagaaaaaatcatgagttggtatggcaaggaaaaggaacattcaagttaactgtccagttacctgcaaccccagatgaaatcgatcatgtctttgaagaggaacttctaacaaaagaatccaagaccaaagaagatgttaaagaaccagatgtgtcagaagaattggatacaaaactccctcttgatggtggattagacaaaatggaagatatcccagaggaatgtgaaaatatttcctctttggtggcatttgaaaacctcaaggcaaatgtgactgacataatgctaatcttgttagtggagaacataagtggcctgtctaatgatgactttcaagtggaaataataagagattttgatgttgctgttgttacctttcaaaagcacatagatactataagatttgttgatgattgtaccaagcaccattcaattaaacaacttcagctttctccaagacttctggaagtgacaaacacaatcagggttgaaaacctgccacctggtgctgatgactacagtttaaaacttttctttgaaaatccctataatggagggggaagagttgccaatgttgaatattttcctgaagagagttcagctctgattgaattttttgacagaaaagtgttagacaccatcatggccacaaaactcgacttcaataaaatgccactttctgtgttcccatactatgcctcattgggcacagccttgtatggaaaggagaagcctctgatcaagcttccagcaccatttgaagagtcactagatcttcccttatggaagttcttacagaaaaagaatcacctcattgaggagataaacgatgaaatgaggcgttgtcactgtgagctcacgtggtcccaactcagtggtaaagttaccatcagaccagcagccaccttagtcaatgaaggaagaccgagaatcaagacctggcaggcagatacttccacaacactctctagcatcaggtctaaatataaagtcaacccaattaaagtggatccaacaatgtgggacaccataaaaaatgatgtgaaagatgacaggattttgattgagtttgatacacttaaggagatggtaatcttagcagggaaatcagaggatgtccaaagcattgaggtacaagtcagggagttaatagaaagcactactcaaaaaattaaaagggaagagcaaagtttgaaggaaaaaatgatcatttctccaggcaggtattttcttttgtgtcacagcagtctactggaccatttactcacggagtgcccagagatagagatttgttacgatagagtcactcaacacttgtgcttgaaaggacctagtgcagatgtgtataaagcaaagtgtgaaatccaggaaaaggtgtacaccatggctcagaaaaacattcaggtttctcctgagatttttcagtttttgcaacaggtaaactggaaagaattctctaagtgtcttttcatagcacagaagattcttgcactttatgagctagagggtacaactgttctcttaaccagctgttcttctgaagccctgttagaagcagaaaagcaaatgctcagtgccttaaattataagcgcattgaagttgagaacaaagaagttcttcatggcaagaaatggaaagggctcactcacaatttgcttaagaaacaaaattcctccccaaacactgtaatcatcaatgagttaacttcagaaaccacagctgaagtcatcattacaggctgtgtaaaagaagtaaatgaaacctataaattgctttttaacttcgttgaacaaaacatgaaaatagagagactggttgaagtaaagccttccttagttattgactatttaaagacagaaaagaagctattctggccaaagataaagaaggtaaatgtgcaggtaagtttcaatcctgagaacaaacaaaaaggcattttactaactggctcaaagaccgaagtactgaaggcagtggacattgtcaagcaagtctgggattcagtctgtgttaaaagtgtccatactgataagccaggagccaagcagttcttccaggataaagcacggttttatcaaagtgagatcaaacggttgtttggttgttacattgaactacaggagaatgaagtaatgaaggagggaggcagccccgctgggcagaagtgcttctctcggacagtcttggcccctggcgttgtgctgattgtgcagcagggtgacttggcacggcttcctgtcgatgtggtggtgaatgcatctaatgaggaccttaagcattatggtggcctggccgctgcgctctcaaaagcagctggccctgagctccaggccgactgtgaccagatagtgaagagagagggcagactcctaccgggcaatgccaccatctccaaggcaggaaagctgccctaccaccacgtgatccatgcagtggggccccgctggagcggatatgaggccccgaggtgtgtgtacctattaaggagagctgtgcaactcagtctctgtctagccgaaaaatacaagtaccgatccatagccatcccagctattagttctggagtctttggctttcccttaggccgatgcgtggagaccattgtttctgccatcaaggaaaacttccaattcaagaaggatggacactgcttgaaagaaatctaccttgtggatgtatctgagaagactgttgaggcctttgcagaagctgtgaaaactgtatttaaagccaccctgccagatacagctgccccgccaggtttaccaccagcagcagcggggcctgggaaaacatcatgggaaaaaggaagcctggtgtccccgggaggcctgcagatgctgttggtgaaagagggtgtgcagaatgctaagaccgatgttgttgtcaactccgttcccttggatctcgtgcttagtagagggcctctttctaagtccctcttggaaaaagctggaccagagctccaggaggaattggacacagttggacaaggggtggctgtcagcatgggcacagtgctcaaaaccagcagctggaatctggactgtcgctatgtgcttcacgtggtagctccggagtggagaaatggtagcacatcttcactcaagataatggaagacataatcagagaatgtatggagatcactgagagcttgtccttaaaatcaattgcatttccagcaataggaacaggaaacttgggatttcctaaaaacatattcgctgaattaatcatttcagaggtgttcaaatttagtagcaagaatcagctgaaaactttacaagaggttcactttctgctgcacccgagtgatcatgaaaatattcaggcattttcagatgaatttgccagaagggctaatggaaatctcgtcagtgacaaaattccgaaggctaaagatacacaaggtttttatgggactgtttctagccctgattcaggtgtgtatgaaatgaagattggctccatcatcttccaggtggcttctggagatatcacgaaagaagaggcagatgtgattgtaaattcaacatcaaactcattcaatctcaaagcaggggtctccaaagcaattttagaatgtgctggacaaaatgtagaaagggaatgttctcagcaagctcagcagcgcaaaaatgattatataatcaccggaggtggatttttgaggtgcaagaatatcattcatgtaattggtggaaatgatgtcaagagttcagtttcctctgttttgcaggagtgtgaaaaaaaaaattactcatccatttgcctcccagccattgggacaggaaatgccaaacaacacccagataaggttgctgaagccataattgatgccattgaagactttgtccagaaaggatcagcccagtctgtgaaaaaagttaaagttgttatctttctgcctcaagtactggatgtgttttatgccaacatgaagaaaagagaagggactcagctttcttcccaacagtctgtgatgtctaaacttgcatcatttttgggcttttcaaagcaatctccccaaaaaaagaatcatttggttttggaaaagaaaacagaatcagcaacttttcgggtgtgtggtgaaaatgtcacgtgtgtggaatatgctatctcctggctacaagacctgattgaaaaagaacagtgtccttacaccagtgaagatgagtgcatcaaagactttgatgaaaaggagtatcaggagttgaatgagctgcagaagaagttaaatattaacatttccctggaccataagagacctttgattaaggttttgggaattagcagagatgtgatgcaggctagagatgaaattgaggcgatgatcaagagagttcgattggccaaagaacaggaatcccgggcagattgtatcagtgagtttatagaatggcagtataatgacaataacacttctcattgttttaacaaaatgaccaatctgaaattagaggatgcaaggagagaaaagaaaaaaacagttgatgtcaaaattaatcatcggcactacacagtgaacttgaacacatacactgccacagacacaaagggccacagtttatctgttcagcgcctcacgaaatccaaagttgacatccctgcacactggagtgatatgaagcagcagaatttctgtgtggtggagctgctgcctagtgatcctgagtacaacacggtggcaagcaagtttaatcagacctgctcacacttcagaatagagaagattgagaggatccagaatccagatctctggaatagctaccaggcaaagaaaaaaactatggatgccaagaatggccagacaatgaatgagaagcaactcttccatgggacagatgccggctccgtgccacacgtcaatcgaaatggctttaaccgcagctatgccggaaagaatgctgtggcatatggaaagggaacctattttgctgtcaatgccaattattctgccaatgatacgtactccagaccagatgcaaatgggagaaagcatgtgtattatgtgcgagtacttactggaatctatacacatggaaatcattcattaattgtgcctccttcaaagaaccctcaaaatcctactgacctgtatgacactgtcacagataatgtgcaccatccaagtttatttgtggcattttatgactaccaagcatacccagagtaccttattacgtttagaaaataacactttggtatccttcccacaaaattattctccatttgtacatatctagttgtaaaacaagttttagcttttttttttaattcctcttaacagatttttctaatatccaaggatcattctttgtcgctgaagtcagtctttcttcagcttccctttcataatggaaatgaacttattatcttgagagcaaataacttggaaaatttaaatgagataatgcagttgcaactgtgtgtccacaagtatggacatcaaatctgtgggaaaagaacaggtttgtattttcaggaaggagagaataacagtcttatagacagagggcacagctaagcacagctgccactgcaggagacaggccccatgtcaggatgccatagtgctgtggggagcacagtattacccagtgggtagggcttctgtcttccctgggagcagggatggtatcttagtcaatttttttcccttgagatgaggtctgtgcctgatgtacaacggatactccataaatgtttgacaaaccaacgaagaatgaaaaaaagcctagtcagactcccatccaaagtaggaactatctctttaacattcttgactcactatcactttacctcaaattgaacagattccatgacggaacttcattcttcacaaactagccagtgacatgtgggacagctctggccagggctctgggactgcagtgtacttgcgctctgcacggtccaggagctgtgatgtggctgtggtctaggggaatcctgcctgccccatggagttgcgcagcacaaccctggctccaattgccagaaggctctttttaatgctgaaccaaaatgtgcctttttttttttttttttgagatggagtttcactcttgttgcccaggctggagtgcaatggcgcgatctcagctcactgcagccactgcctcccaggttcaagtgattctcctgcctcagcctcccgagtagctgggattacaggcatgcgctaacacacccagctaattttgtatttttagtagagacgaggtttctccatgttcgacaggctggtctcgaactcccacctcagcctcccaaactgctgggattacaggtgtgagccaccgtgaccagccaatgtgccttcttatagtgtctactcattggtctttgttctgcccagtgataacaatgggataacgcctgctacacatcttcattgtgaaacccttcccctgtgctgagattaaatgaactctaagattattaaatagtatattttccttgacagcctagcgtttgatgattttaaagccttatgtataaataaaccaaaggaagtaagcagtcatattgctaatttgctaactcctatctattgaatggtgaagttttaaaaatttccccaggtaagtttaagattcaaacaccatctattgagcacctacattgtgtgccaggtagtaaaataggtgctttcatacacattgtctcaattcctgtgaggtcagaattatctctgcatttgaaacttgaggaaacatgctcagagtgcaagaagcttccttgcctgagatcacctagaaaggaaccctcagagccggcaactgaatcttggtccctgtgatgtcaagcccattgctctcccactgcagaacatggcctctagattaatgccaccgattcaggaacacctccgacagtcttgaaatacccccatgttgccttgtttgttttttccttctggcttcttctattacagtctcttcattggaagctctgtaggccaaggccagagctgatactgacacggagccaatgcagatagcacatcagatgctaggggtcgctgggaggattaagggacttaatctgctaggaacacctgtacttgaagtggaggaggctagggggccacagttgctgcttcattaacatagaggttttggatttttttctcttgtggtttgttttttaagtggattggcagactccttgttgcttaagagtggctttctaggcaggccactggcatctgaattcatcattgacaataaatgtaagaaattggaataaaaaagagagacctgctgttattcgcttttgttctccagtgatttgattaactcagggcaaggctgaatatcagagtgtatcgcactgaagaataataatccattcagtaatgttatagttatcctcaatctaaatatgtcaactgtcattttgctacttttcaaataaaatacttgaaaactgtca

SEQ ID NO: 22869 - DNA, 581 bp, Homo sapiens
agtccggcggagagcggagctgaggatggctgtgcccggctccttcccgctgctggtcgagggctcctggggccccgaccccccgaagaacttgaacaccaagttgcagatgtacttccagagcccgaagaggtcgggaggcggcgagtgtgaggtccgccaggatcccaggagcccatcccgcttcctggtgttcttctacccggaggacgttcggcagaaggttctggagagaaaaaatcatgagttggtatggcaaggaaaaggaacattcaagttaactgtccagttacctgcaaccccagatgaaatcgatcatgtctttgaagaggaacttctaacaaaagaatccaagaccaaagaagatgttaaagaaccagatactataagatttgttgatgattgtaccaagcaccattcaattaaacaacttcagctttctccaagacttctggaagtgacaaacacaatcagggttgaaaacctgccacctggtgctgatgactacagtttaaaacttttctttgaaaatccctataatggagggggaagagttgccaatgttgaatattttcctgaag

SEQ ID NO: 22870 - DNA, 1518 bp, Homo sapiens
ttcctaggttgaaccgcaatcctttaagaagtctctgagggaagaggaaatattttgagaactattgttatcaactctttgatatctgatgatcaatgctccaaagaattggattaatatttttacacaatattgttgtagtcagtaactgtttctatttccaggcatttttagatgaattcactaactggtcaagaataaatcccaacaaggccaggattcccatggcaggagatacccaaggtgtggtcgggactgtctctaagccttgtttcacagcatatgaaatgaaaatcggtgcaattacttttcaggttgctactggagatatagccactgaacaggtagatgttattgtaaactcaacagcaaggacatttaatcggaaatcaggtgtgtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggaaatgccggaaaaaaccctatcacagttgctgataacataatcgatgctattgtagacttctcatcacaacattccaccccatcattaaaaacagttaaagttgtcatttttcaacctgagctgctaaatatattctacgacagcatgaaaaaaagagacctctctgcatcactgaactttcagtccacattctccatgactacatgtaatcttcctgaacactggactgacatgaatcatcagctgttttgcatggtccagctagagccaggacaatcagaatataataccataaaggacaagttcacccgaacttgttcttcctacgcaatagagaagattgagaggatacagaatgcatttctctggcagagctaccaggtaaagaaaaggcaaatggatatcaagaatgaccataagaataatgagagactcctcttccatgggacagatgcagactcagtgccatatgtcaatcagcacggctttaatagaagttgtgctgggaaaaatgctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagctatttgtggtattctttgataatcaggcttacccagaatatctcataactttcacggcttaaaaatatttttatcatcaaagagatgatttaagtcatctgtaagaacaacatgcaatctttgtctttgcttctggcctgtgtaagcaga

SEQ ID NO: 22871 - DNA, 2156 bp, Homo sapiens
agagaaaagaagttcgaggcacaagcctgttgggtggggcgcaactgcagtcccagcgagctgaggatggctgcgccaggcccccttcctgccgctgctctgagtccaggggctccgacccccagagaacttatgcacggagttgcaggtgttacttccagagccggacgagatcgggaggcggggagcgtgctgccggccgggaaccgtggggcgcggaaggcctcccggcgctcttcctcccggagtatgtccagagacaacaagttcagcaagaaagattgtctttcaatcaggaatgttgtagcttcaatccaaaccaaagaaggtctgaatctcaagttgataagtggagatgttctgtacatctgggccgatgtcattgtcaacagcgttcccatgaatcttcagcttggaggaggaccactatctcgggcatttttgcagaaagctggtcccatgctccagaaagagttagatgacagaaggcgggaaacagaggaaaaagtaggtaacatattcatgacaagcggctgcaatctggactgcaaagctgtgctccatgctgtggctccatactggaataatggagcagagacttcttggcagatcatggcaaatataatcaagaaatgtttgacaactgtagaagtgctatctttctcatcaatcacatttcccatgattggaacaggaagtttgcagtttcccaaagctgtttttgctaaactaatcctttcagaagtgttcgaatacagtagcagcacaaggccgataactagccctttacaagaagtccactttctggtatatacaaatgacgatgaaggctgtcaggcatttttagatgaattcactaactggtcaagaataaatcccaacaaggccaggattcccatggcaggagatacccaaggtgtggtcgggactgtctctaagccttgtttcacagcatatgaaatgaaaatcggtgcaattacttttcaggttgctactggagatatagccactgaacaggtagatgttattgtaaactcaacagcaaggacatttaatcggaaatcaggtgtgtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggaaatgccggaaaaaaccctatcacagttgctgataacataatcgatgctattgtagacttctcatcacaacattccaccccatcattaaaaacagttaaagttgtcatttttcaacctgagctgctaaatatattctacgacagcatgaaaaaaagagacctctctgcatcactgaactttcagtccacattctccatgactacatgtaatcttcctgaacactggactgacatgaatcatcagctgttttgcatggtccagctagagccaggacaatcagaatataataccataaaggacaagttcacccgaacttgttcttcctacgcaatagagaagattgagaggatacagaatgcatttctctggcagagctaccaggtaaagaaaaggcaaatggatatcaagaatgaccataagaataatgagagactcctcttccatgggacagatgcagactcagtgccatatgtcaatcagcacggctttaatagaagttgtgctgggaaaaatgctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagctatttgtggtattctttgataatcaggcttacccagaatatctcataactttcacggcttaaaaatatttttatcatcaaagagatgatttaagtcatctgtaagaacaacatgc

SEQ ID NO: 22872 - DNA, 1867 bp, Homo sapiens
atgaagcatactgcatttttagatgaattcactaactggtcaagaataaatcccaacaaggccaggattcccatggcaggagatacccaaggtgtggtcgggactgtctctaagccttgtttcacagcatatgaaatgaaaatcggtgcaattacttttcaggttgctactggagatatagccactgaacaggtagatgttattgtaaactcaacagcaaggacatttaatcggaaatcaggtgtgtcaagagctattttagaaggtgctggacaagctgtggaaagtgaatgtgctgtactagctgcacagcctcacagagattttataattacaccaggtggatgcttaaagtgcaaaataataattcatgttcctgggggaaaagatgtcaggaaaacggtcaccagtgttctagaagagtgtgaacagaggaagtacacatcggtttcccttccagccattggaacaggaaatgccggaaaaaaccctatcacagttgctgataacataatcgatgctattgtagacttctcatcacaacattccaccccatcattaaaaacagttaaagttgtcatttttcaacctgagctgctaaatatattctacgacagcatgaaaaaaagagacctctctgcatcactgaactttcagtccacattctccatgactacatgtaatcttcctgaacactggactgacatgaatcatcagctgttttgcatggtccagctagagccaggacaatcagaatataataccataaaggacaagttcacccgaacttgttcttcctacgcaatagagaagattgagaggatacagaatgcatttctctggcagagctaccaggtaaagaaaaggcaaatggatatcaagaatgaccataagaataatgagagactcctcttccatgggacagatgcagactcagtgccatatgtcaatcagcacggctttaatagaagttgtgctgggaaaaatgctgtatcctatggaaaaggaacctattttgctgtggatgccagttattctgccaaggacacctactccaagccagacagcaatgggagaaagcacatgtacgttgtgcgagtacttactggagtcttcacaaagggacgtgcaggattagtcacccctccacccaagaatcctcacaatcccacagatctctttgactcagtgacaaacaatacacgatctccaaagctatttgtggtattctttgataatcaggcttacccagaatatctcataactttcacggcttaaaaatatttttatcatcaaagagatgatttaagtcatctgtaagaacaacatgcaatctttgtctttgcttctggcctgtgtaagcagatgaaagtttcccttttaggtgccaaaatgctgaaaattacctttttaaagtgctctattgctgcgatttgtagcatacctttttttctcagcaaattgatgggtggaagctgagaaatgtatggtaaatgtcacagagctacaaccattcacagacaccaaatctctaggagaataaaaagcacattattctttttctatcagaaaaaaacaagatgcatcaccttaaaaccaagatgacattgttcttcttggaacatgttaagacatcgaatggtggcgggttaaactgtactgcttaagtggagcggctaccgttatgcatctatcacagttggggattttgccttattaaggaaaacttgtcaatagttcagctgaaatgactgaatcacagaatattaactctgttatggaacaaatcataacagattttacctgtttacatttcaggtaaaaatgtatcgcattgttatctaatattaaaaaattacccccaatt

SEQ ID NO: 22873 - DNA, 3198 bp, Homo sapiens
gggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcaggtaggattacctcgctctcactcttgtttcagaaagtctttgctcagatctttcctcagtggagaaaggggaatacagaagaatgtctcccctacaagtgctcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtgct

SEQ ID NO: 22874 - DNA, 3025 bp, Homo sapiens
gagtaggtccggtgcctctgggccctcggggtcccctctcctgcaggctcgaggtgggcggggagaagggggacgggcgcggacccgggtcccagggccaggcctcccttgtgagtagactatgcaaagaaaaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcgtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagt

SEQ ID NO: 22875 - DNA, 3091 bp, Homo sapiens
gggcttcgtgttcctgggtgctgaccgtgcactccccgccgcccgaggacttagagctctggaagtagctctccagcttccttcgtactcgggggccggacttgtacacccgcacgaggagcggggacggcgggcgcagaagtgggccaccatatctggaaactacagtctatgctttgaagcgcaaaagggaataaacatttaaagactcccccggggacctggaggatggacttttccatggtggccggagcagcagcttacaatgaaaaatcagagactggtgctcttggagaaaactatagttggcaaattcccattaaccacaatgacttcaaaattttaaaaaataatgagcgtcagctgtgtgaagtcctccagaataagtttggctgtatctctaccctggtctctccagttcaggaaggcaacagcaaatctctgcaagtgttcagaaaaatgctgactcctaggatagagttatcagtctggaaagatgacctcaccacacatgctgttgatgctgtggtgaatgcagccaatgaagatcttctgcatgggggaggcctggccctggccctggtaaaagctggtggatttgaaatccaagaagagagcaaacagtttgttgccagatatggtaaagtgtcagctggtgagatagctgtcacgggagcagggaggcttccctgcaaacagatcatccatgctgttgggcctcggtggatggaatgggataaacagggatgtactggaaagctgcagagggccattgtaagtattctgaattatgtcatctataaaaatactcacattaagacagtagcaattccagccttgagctctgggatttttcagttccctctgaatttgtgtacaaagactattgtagagactatccgggttagtttgcaagggaagccaatgatgagtaatttgaaagaaattcacctggtgagcaatgaggaccctactgttgctgcctttaaagctgcttcagaattcatcctagggaagagtgagctgggacaagaaaccaccccttctttcaatgcaatggtcgtgaacaacctgaccctccagattgtccagggccacattgaatggcagacggcagatgtaattgttaattctgtaaacccacatgatattacagttggacctgtggcaaagtcaattctacaacaagcaggagttgaaatgaaatcggaatttcttgccacaaaggctaaacagtttcaacggtcccagttggtactggtcacaaaaggatttaacttgttctgtaaatatatataccatgtactgtggcattcagaatttcctaaacctcagatattaaaacatgcaatgaaggagtgtttggaaaaatgcattgagcaaaatataacttccatttcctttcctgcccttgggactggaaacatggaaataaagaaggaaacagcagcagagattttgtttgatgaagttttaacatttgccaaagaccatgtaaaacaccagttaactgtaaaatttgtgatctttccaacagatttggagatatataaggctttcagttctgaaatggcaaagaggtccaagatgctgagtttgaacaattacagtgtcccccagtcaaccagagaggagaaaagagaaaatgggcttgaagctagatctcctgccatcaatctgatgggattcaacgtggaagagatgtatgaggcccacgcatggatccaaagaatcctgagtctccagaaccaccacatcattgagaataatcatattctgtaccttgggagaaaggaacatgacattttgtctcagcttcagaaaacttcaagtgtctccatcacagaaattatcagcccaggaaggacagagttagagattgaaggagcccgggctgacctcattgaggtggttatgaacattgaagatatgctttgtaaagtacaggaggaaatggcaaggaaaaaggagcgaggcctttggcgctcgttaggacagtggactattcagcaacaaaaaacccaagacgaaatgaaagaaaatatcatatttctgaaatgtcctgtgcctccaactcaagagcttctagatcaaaagaaacagtttgaaaaatgtggtttgcaggttctaaaggtggagaagatagacaatgaggtccttatggctgcctttcaaagaaagaagaaaatgatggaagaaaaactgcacaggcaacctgtgagccataggctgtttcagcaagtcccataccagttctgcaatgtggtatgcagagttggctttcaaagaatgtactcgacaccttgcgatccaaaatacggagctggcatatacttcaccaagaacctcaaaaacctggcagagaaggccaagaaaatctctgctgcagataagctgatctatgtgtttgaggctgaagtactcacaggcttcttctgccagggacatccgttaaatattgttcccccaccactgagtcctggagctatagatggtcatgacagtgtggttgacaatgtctccagccctgaaacctttgttatttttagtggcatgcaggctatacctcagtatttgtggacatgcacccaggaatatgtacagtcacaagattactcatcaggaccaatgagaccctttgcacagcatccttggaggggattcgcaagtggcagccctgttgattaatctctacatcattttaacagctggtatggccttaccttgggtgaactaaccaaataatgaccatcgatggctcaaagagtggcttgaatatatcccatgggttatctgtatggactgactgggttattgaaaggactagccacatactagcatcttagtgcctttatctgtctttatgtcttggggttggggtaggtagataccaaatgaaacactttcaggaccttccttcctcttgcagttgttctttaatctcctttactagaggagataaatattttgcatataatgaagaaatttttctagtatataacgcaggccttttattttctaaaatgatgatagtataaaaatgttaggataacagaatgattttagattttccagagaatattataaagtg

SEQ ID NO: 22876 - DNA, 2782 bp, Homo sapiens
ctggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccaggtgctggtcggggccggagccggggcctgggccgcggagggggcgggcctgagggcggcggtttcccgaacggagcggggcctgctgagcgggcgcggcaccagccgccgcaacccaaagccccgggcttcctgcagccaccgccgctgcgccagcccaggacgaccccgccgccaggggcccagtgcgaggtccccgccagcccccagcggccttcccggcccggggcgctcccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttgctagttggttagatgcttatcctttaaattctacttttcttgaggggaaaaagtcttcttctggaaatacatattactgcaaaaatgtagcatccttttttaggtaggagtattatagctttcattttagtttgacatttagtgtcccaatgaattgaatttcaaatatgaatcataatcttgaaaatctttagcactaaagtcttggaatatatcaacaactgatttacatatgcagatgctatttgataccaagggctttttaaatgtcatgggggggaaaaacccaacttggtgaactcccagctaaacaaccaagacttcactgaagatttattccaattctagaattgttcttttttatttttattttttcaactgactaacttcattaccttaaaggctagaacattattctgctttatttatatggctttctcacttttattttgtagcatgggttgcatcgacttttttactagagaattttactagatatttgtcattcaagttttcatctgctttataattgatacaccttgagggtcacttttctaatacttttactataatgtggtaccacctcagccctaataaataatatttttacctaatgtcaaatctttttccagctaactaaaaactgtgtacaaaaggattgcttgtaaatatgcatgtaaatagttctgttaataacccactgttttacatttggtacatctgtgtctgctaatacagttagctttctcacttttctgcttgtttgttcagtctgaattaaaattagactttgaaaataaagcttaaatagttgtttcctctaaa

SEQ ID NO: 22877 - DNA, 1814 bp, Homo sapiens
acattttcttgaaatttctggaggggaaggttaacgggaagagaacgaagcttgttaaacgtaggtgtgacctactgtggtaaacacctagggtgaattaaagaggggacacatattttgattccgtttctactcccttcccccgatgctaacggagcaggtgacagtctcccagggaccactcctcagcagtccgcgggtctcggccggagccgagtcattgaacacacctgtgcgccagcgaaccctggcgcagggtccacgccccctccccccgtgtttttatttcccgggcgtcaactgtcggtctcgcacgtctctcctgagaactaccgagtaggtcgggcctgcctgtgagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaatttt

SEQ ID NO: 22878 - DNA, 1734 bp, Homo sapiens
gttttgggggagaactggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagattaccaagagaaataccaagaattacttgaaagagaggacttttttccagattatgaagaaaatggaacagatttatccggggctggtgatccatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaataaatgaaatgttgaaaattttg

SEQ ID NO: 22879 - DNA, 752 bp, Homo sapiens
tggggggaggggccgggtgcgcggtctcggagttcggggtcccgggaggaagtaaaaatcgcctcccctcagcagccctctaaagcgagaccctagcgagtaaccacctcttttccaccgacccctttaaaacgacagagaggaaaaaagctcgcaagcactcatttgagaggcagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacc

SEQ ID NO: 22880 - DNA, 706 bp, Homo sapiens
caagatgaaaaagagggcagagttacactgaaagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatgg

SEQ ID NO: 22881 - DNA, 1603 bp, Homo sapiens
ggaaagccgagggtagccgagcggggcgggcgctctggagcggcgggtgctcgggctgccgtccgctccgccagaagcaccgagcagccgagccggggcccgccgccctcctcctccatgaggcccgagtgaggcgcggcggctatagccgacccgcggcgccttccccccgcgtcctatcgcgagcgcagcggcagcggcccctggaggaggaggcggaggaggaggagcatgtcggacggtttcgatcgggccccagagcaaacgaggcccctgagagctccacctagttcacaggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacaggccacatctatcccaaatttctcttatatgggagctcgcctgtgtaattacctgtcccatcatctgacaattagcccacagagtggcaacttccgccaattgctacttcaaagatgtcggactgaatatgaagttaaagatcaagctgcaaaaggggatgaagttactcgaaaacgatttcatgcatttgtactctttctgggagaactttatcttaacctggagatcaagggaacaaatggacaggttacaagagcagatattcttcaggttggtcttcgagaattgctgaatgccctgttttctaatcctatggatgacaatttaatttgtgcagtaaaattgttaaagttgacaggatcagttttggaagatgcttggaaggaaaaaggaaagatggatatggaagaaattattcagagaattgaaaacgttgtcctagatgcaaactgcagtagagatgtaaaacagatgctcttgaagcttgtagaactccggtcaagtaactggggcagagtccatgcaacttcaacatatagagaagcaacaccagaaaatgatcctaactactttatgaatgaaccaacattttatacatctgatggtgttcctttcactgcagctgatccagatacttggatgatattgatgatgagatggacccagagatagaagaagcttatgaaaagttttgtttggaatcagagcgtaagcgaaaacagtaaagttaaatttcagcatatcagttttataaagcagtttaggtatggtgatttagcagaacacaagagagcaagaaaatgtcacatctataccaaattaaggatgttgagttatgttactaatgtatgcaactttaattttgtttaacactatctgccaaaataaactttattccctataacttaaaatgtgtatatatatataatagtttattatgtacagttaattctactgttttggctgcaataaaatcgattttgaaata

SEQ ID NO: 22882 - DNA, 726 bp, Homo sapiens
tattttcattggacagcactgatgcaagatgaaaaagagggcagagttacactgaaaggtagcacattttcttgaaatttctggaggggaaggttaacgggaagagaacgaagcttgttaaacgtaggtgtgacctactgtggtaaacacctagggtgaattaaagaggggacacatattttgattccgtttctactcccttcccccgatgctaacggagcaggtgacagtctcccagggaccactcctcagcagtccgcgggtctcggccggagccgagtcattgaacacacctgtgcgccagcgaaccctggcgcagggtccacgccccctccccccgtgtttttatttcccgggcgtcaactgtcggtctcgcacgtctctcctgagaactaccgagtaggtcgggataaaatcccacagcagaactcggagtcagcaatggctaagccccaggtggttgtagctcctgtattaatgtctaagctgtctgtgaatgcccctgaattttacccttcaggttattcttccagttacacagaatcctatgaggatggttgtgaggattatcctactctatcagaatatgttcaggattttttgaatcatcttacagagcagcctggcagttttgaaactgaaattgaacagtttgcagagaccctgaatggttgtgttacaacagatgatgctttgcaagaacttgtggaactcatctatcaacag

SEQ ID NO: 22883 - DNA, 1459 bp, Homo sapiens
gaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattgggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaa

SEQ ID NO: 22884 - DNA, 2294 bp, Homo sapiens
ctggggtttggggagagaggggcggagggactggcgggctcttggcgtcttgggggaacgctgcaaccgtcgacgggcctgatcagaagatcgtctttctcccgtttcttcgccatcgctaccccttatttttggttgtattgcagctcatgccctggaaaaaagaacctttggggtactgggaacccttaccctaggagggcgttgagttagatgaactttaaggtcctcttaccttttaataattttctgtgcttactctcctccttccccaccatcgccaccagaaataaataaggcttgtggtgaacttaggtcttcaaaacatttgttgcagcagccagcagtgatattttttagggactcctaaaaggggtcttacctgcttccttttgtttcttttttccctgatttggcacccgtatcaactcataaaaaccccaaactctagaaagaatttggcttccaatttgccttggaaggtgtagcagctgacagcctttgacgtttatttcaacggaaagtagatgttcatgttgggtgtgctggctaatgttgaaacgtggtggcattgttttttcacagatttcattagcacagttagatcaggtgttggtttatattttcattaagtcgcttttgaaatttcttctggcgtaggttgtgtttgcaataagtaaaagttctctacaataatttttaatgagactccactatttgcttttgtgattctgtttccagttagtgaaagacaggatatttggggaaaattagtctgtttatactacttgtcagttgtgaacttgaataaaactttttcacacacacacaaaatcacaggataggtaacttgacaagaactatagaacccacttgtgtttctttaagggatggaggttagggaatggagatttcctctaatgattcaaggctgtgcacgttgctccttaggaactcaaattgaggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaaccttaccaaattgtctttttttgaggctaatctatcacttgttaatgtctaaactttaaaatcagtacatttaatttgagttccaactgttaagcatatttctcagacttaaatttgattatgtccccatcaaaaagaatctccattttctgaaggtctgttagttaatttgagataatttgttaaaggcaagtatgtcatattactgaggctacaagttagtcagcagatgagtgccagtccagccttttctggtatgttattgttagaaatattgagttctaatgttacatctgaggaagtatgtaatttgagaattgtaacttctaagggattcactgcatcatagctatgcctgtatggagtctaacatatgaccaataccaacccataatccagctgaacaaagatactgtaacatgatttgagtggtgcttttccttgctttgttaaccatcacgagagtctgcagcacaacttttaacaaagctagaacagttttggcttcttaaacttcatatttgggtaggttaagctgccatacgtgttcagtgtgaatagtgtttaagttgaaaatattgtaaaaaaattatattttttcaaaaatatttaaaaaaataaataatagtagaactga

SEQ ID NO: 22885 - DNA, 776 bp, Homo sapiens
ggaagatgggcgggtgtgggaacagtggtacgcccccattcctgccttccagagagaacgtgcgacagcgttcctgctacacccggcagccggccgtaggggcgcgctggaaaggctgctgcgcgtgcacacgtgtgcagccttggagacagacttcggggtcgcgcgttctcgcgcgcgctctctagtggcttcggagggcagagctgacagaacaagagggcggggttggcggcgacggaagtgaagtcacttccgggctggggtgtttgtttggactggagaagggaggcggcgggcgaagcgcacgtcgagcgggggagcggcgctgcctgtggagatccgcggaggccgacaggattcgttggctgccgtccccgctgctgtgcattggggatggaggttagggaatggagatttcctctaatgattcaaggctgtgcacgttgctccttaggaactcaaattgaggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgac

SEQ ID NO: 22886 - DNA, 858 bp, Homo sapiens
ggggagagaggggcggagggactggcgggctcttggcgtcttgggggaacgctgcaaccgtcgacgggcctgatcagaagatcgtctttctcccgtttcttcgccatcgctaccccttatttttggttgtattgcagctcatgccctggaaaaaagaacctttggggttaaaaacgacaaccaacatcagccatgaaagatccaagtcgcagcagtactagcccaagcatcatcaatgaagatgtgattattaacggtcattctcatgaagatgacaatccatttgcagagtacatgtggatggaaaatgaagaagaattcaacagacaaatagaagaggagttatgggaagaagaatttattgaacgctgtttccaagaaatgctggaagaggaagaagagcatgaatggtttattccagctcgagatctcccacaaactatggaccaaatccaagaccagtttaatgaccttgttatcagtgatggctcttctctggaagatcttgtggtcaagagcaatctgaatccaaatgcaaaggagtttgttcctggggtgaagtacggaaatatttgagtagacggggccctcttttggtggatgtagcacaatttccacactgtgaaggcagtattagaagacttaattgtaaaagctctcttgtcactgtgttacacttatgcattgccaaagtttttgttagtcttgcatgcttaataaaagtgctgagactgttactaagtaaaaagctgtcaaacatttactgaaaatagaattggccccatggcttgatgtgaagacagcaaggaaagaagcaccagtcaagttgtgaacaagcaccaaattaaaagacctaaa

SEQ ID NO: 22887 - DNA, 6279 bp, Homo sapiens
ctggcaagtggtagtggcgcttctcgggtgctgtgcttcacgttttggtactaaaggccgagactgttgtggcgacggcgacctctacggcaacggcttaagctctcggaggagtggcagagtacgatctgaaggaggggcttctggttagcccaggttccatcataatgaatggatccaatatggcaaatacatcaccgagtgtaaaatccaaagaggaccaggggttaagtgggcacgatgaaaaggaaaacccatttgcagagtacatgtggatggagaatgaagaggatttcaacagacaggtggaggaggaactgcaggagcaagacttcttggaccgctgcttccaagagatgctggatgaagaagaccaagactggtttattccctcacgagacctgcctcaggccatgggacagttgcaacagcagttaaatggactgtcagtcagtgaaggtcatgattctgaagatattttgagcaaaagtaacctgaacccagatgccaaggagtttattccaggagagaagtactgagccgagaaagctttgaggaagacttgtctgtccccacatctggggatagtaatgcacaaaatggtggagctgaagagggggatggggcgggcgaggggtgcacagcgggaaggggagtggtggtctcacaatactgtgactctgagtaactaatatgctcagtcttattctaagcctctgagtatttctattttgttctgctgacttttgtttggggagtttcctgttttgtttttttaaatagctctttcgagttaaggaaattgcattttccccccttcatcagaagtgttccgcggtgtgtatttaaacaaaataagctgactaagaaaaactggatatttaggaaatgcccctctcaccctgctgtatacttatcagggacagtgagcacctggagagctttttgtggaatctattgagttggatgggaaaagggacaagcagaaagagcaggtggtgcaaactggaatttgaggctcagctgccccacccccggggtctcctgcaatgaactcggataaccaatgtgctgtcaagcccttgcctgtttgtcctgaaccccattcaagaaaacacagacttaaagtacttagtttacagtaacttttgatgattgttgaaagttgtaaatcagaaggtagggctgtgatggtggttgtcacttgagtcatttagttactgttgtcctgttcataagcctgtgttcaccaccaccatcagactcaccatttataagtagaagagcactagggttgatctgccacctcatctttcatgaagtctattccccagcctcctttttaagaaaagatactgctaccaaaggcataggggaggcctgctgtgctggcaattagcatgagcctgcagaagtcatccttgaatctgttgtgtcttaattttatttggacagtttttttttccagcctcatcaacacttggtcttcctggtgtcttaattccctcagacaagtttatgcacttttttaaggaaatatttttcaggacactagtaagaagctcagttcacagtttggatatttcttcccacattacagaattatggaaaggaactcaaaatcagcctaggaaagtgagtcctgcttgacccatgtgactgtgtacctgaccttctgggatcttttcagctattaaaacattttactgttcccacatacccagctttgcaagttttgtagattgacctcttagggtgtgtttctttgtctttcctgcctttaacttgctggggtcttttgttgctacccctaaggaactaaactgggtgccaggagctaccttcgtgtatagagatgtagatggcagtgtggggtacaggagagccatccaggccattctcccagggatgaggaattggagagccctgaagataatagtggcttctttctgattgctactgtgctgtgtgataggcctaatagggaaaagatatgtaacttgaaacaaagttggtataaattcagtatgtggctgtgggacagaggttggaaggaaaggactagggtatggaaagctgaagaaattctccttatgagctctcgttgactttttgaacagtgataagctaatgccagatttaaaatacacattttttcctatttgagtctttaggattatatcatttgaaaaaattgccttccttgttaggtcacatgtcataggagagtagcttagagaacttgcattaccagacagacacattaattcccaaagcctctatgttgagagaatgaaactgttaactctttttcagagaggactatgaataaagaaacttctttattcaagcttcagctttcagctgggttgtttcctctaaaagggaaagggcattgcaagtgcatagaggaaatctctcccttctgggactgcttttcctccttcatcctcgtgagcctgtccaagctcagaattccgaaggctgttagaaatgcgttgggattgcagagagaaaggagcttgtctttccttctgctgtgctggtctgttttggatgtcagtcttcaggactatgaaaacttcctgccagtttagcatggacactgagggctggcatttctagtcttcttcagacactgaacatactgactccaggtataggaagcagctagcaaattgattcttttttaaatgcataggactctgcttccggcggttcctcttgtagtccaactctttttgccatctatttatgttgggaggtaggggcacaattgtcactcacaacacaggctagttagagtttgctaccttcttagcagaaaatgcatgtgtgtcttgttggaccttcactggggaaaggctgggagcctctggctgtcagtgacttttctcacagaagaagaaccagcaagccagactggacacctttaccctttaatggtaagacttgtatttataaggggtaattttgatgttgaatttaagccactactttgtttaaacttttttaaattggcaactagaagtttgagaatttgtatagaaatggaacatgtatttctaacagttgccaatctggctggtcccaatgttagtttattagtgattgatctgtaattattgggattatttattcaactctaaaattccaagatgaaaataatttatctctttcttttcaagggaaaaaacccaaatgaatgcattttcagtttctccaggcctttgaactgcagcagaaaattcaaggatacagcctaggcctgggcaaatgcagccctgggtctttgggccagtttctgacaataatagttgagttttgggaatcacataagggtgaaaccagaaacgatcctaaggaaaggcttgacctttgttaacacctttagtttccaaagtcacagcagctggggtccctcttttttttttttttttctttttttttgagacatagtctcactctgtcacccaggctggagtgcagtggtatgaccatagctcactgcagcatcaaattcctaggctcaagcaatcctcccatcttagcctcccgagtagctgggacaacaggtacgcaccaccacggccagctaattatttttattatttttattttttgtagagactggatcttgctctatttcccaagctactcttgaattgttgtgctcaagtgattctcccatctcagcctcccaaagtgctgggattataggctgggtgtggtgagccaccccagcctggggtctctttaattaaggttataatgctaaccatggcttaaaatactaagcaacattttccaaattgtttattactattgctttgattttggagaagctgggaagtaaggaggtgaggtgaatactctgataattaacacgtgttagagaggaaagttgtgtgaagaggctgccaaagtaaacagcacgaatgaatcttcttgtactagggctgctgcaaaccccaggtagacaaatgacagcccaggctcctgaaccatcaggaacccaggaatctacccaactgtgaggagggggcaggccttcgtcaataagggtcccaccatcacgggctaataatctttctcagtttaggtgatattgaggtattgaaactgttagaaatctgacagatttgaccaagatttggagacgtccacataattgggaaggactgagtgtccctagccactctcctctgggataacgcggacgtcattagtttgcgaagtgggtggggagaacaggaggattgactctaatttggtgtgtagtgggggccttgatgtccttctgcctctgtccacatttccccatgtgactcattgcaccctgcattgctcacagggatcattagttctcccggtagacagagcacctctgcagcctctgctctgctgccttgtgaatttcctacacagacttggttagttacaatttggaaacagtttttttgggtttttttcctttgttttaatcttctcacaatgaagctgctattggtgacagggacaggggagcaggaagccaacccagggaaacatgcgagtttcctgcacaccacttagtcacctgccctcactggccaaccccctactgctgttcccagtcagtctggtttttagaggcatcgtggcaatagaatagctggatacactaatctctacaaggtgtcaggcaggagattcaccttccccagtcccaggggacaggagagaaatctgtaaagggacagatgcaccatctttatttcaaaagaaaaagctccctcagattgtgttactaggagtctcttttgtgacatttactgagctttctccccaatcttaccttcctattggctactttttaaataaaaataaacattttaggctaatatgacaaaaatgagataaaatcttaaaaacattgtactagtgtacagttactaaaatgtgcttactacaaaacagtaaaatatttcactctgtaaatcatcactaagtagttattctgtcctgttgattatgagcctccaaaaatgtttaatgcttgaaggatggtttgggaggcagggaatccttttcttaaaacaactttaatgaggcatatgttacatatcataaaacacccatttcaagtgtacatttcagtgattttagtaacttccctcagtggtgtagctgtaactattactcagttttagaacatttttatccctcccaataagatccttcatgctcttttacagttaatcctgttcttacccccggcaaccactaatctactttctctataaatttgccctttctggacagttcaaatcaatggaatcatacaatatgtggtcccttgggtctggcttttttacttagctaatgtttttgaggtttgtccatgacagataacgtcttggtagtttgttccttttattgctgagtagaattctgttgatggatgtaccacattttgtcagcagagagccttttaaacttggattccaacttcctgttgtctaaacggaaccctccgaacgtaggacttataggggaagctgctgtgcatgtcaaaaaaactactaatcagaatgagctttgtcatccagagccagaactgctgcagaaatttttataattttgcaacttctttttttacaaggaacttttgtgctactacacatcaggacttttgaagcatccaataaatccatttaataagtatgagcatgtgtctgagtggacaagaaagtgaaaccatccatgctacattggataatttttcctcccccagactggacagggaatctcagctttcaaaacagagtaacctggctccacttacaaagctgcacaggcattaaagatcgtgctgcctttgttaggcagatttggaggggaggcccaacagcaaagatggagaggaaaaagggagtggagcttgtggaacaggaagccccccagggtctgtgcagggctgctcagctcttgaggatgttgtggatggtgaagtggtgatggtgtcccggagcagcccagcacctccactgggcccagaaggtcttgacttcggacacttacccctgtttcacaagtgtttataaagctgtttttgctttttttcccctaatcattacttggtagttattaatccttctttgggggagggacagggctttaaaactgaagaaaataattttcataaaaatatcaaaaatggaaaaaagttactttgtaaaaaatttgctatacaaaccaaatggcagctgttgagaatctcaataaaatgttaaatgc

SEQ ID NO: 22888 - DNA, 3090 bp, Homo sapiens
gtcgcggcttgtgtgcctgcgggcagccgtgccgagaatgaaccccagcacccccagctacccaacggcctcgctctacgtgggggacctccaccccgacgtgactgaggcgatgctctacgagaagttcagcccggcagggcccatcctctccatccggatctgcagggacttgatcaccagcggctcctccaactacgcgtatgtgaacttccagcatacgaaggacgcggagcatgctctggacaccatgaattttgatgttataaagggcaagccagtacgcatcatgtggtctcagcgtgatccatcacttcgaaaaagtggagtgggcaacatattcgttaaaaatctggataagtccattaataataaagcactgtatgatacagtttctgcttttggtaacatcctttcgtgtaacgtggtttgtgatgaaaatggttccaagggttatggatttgtacactttgagacacacgaagcagctgaaagagctattaaaaaaatgaacggaatgctcctaaatggtcgcaaagtatttgttggacaatttaagtctcgtaaagaacgagaagctgaacttggagctagggcaaaagagttccccaatgtttacatcaagaattttggagaagacatggatgatgagcgccttaaggatctctttggcaagttcgggcccgccttaagtgtgaaagtaatgaccgatgaaagtggaaaatccaaaggatttggatttgtaagctttgaaaggcatgaagatgcacagaaagctgtagatgagatgaatggaaaggagctcaatggaaaacaaatttacgttggtcgagctcagaaaaaagtggaacggcagacggaacttaagcgcacatttgaacagatgaagcaagataggatcaccagataccaggttgttaatctttatgtgaaaaatcttgatgatggtattgatgatgaacgtctccggaaagcgttttctccatttggtacaatcactagtgcaaaggttatgatggaaggtggtcgcagcaaagggtttggttttgtatgtttctcctccccagaagaagccactaaagcagttacagaaatgaacggtagaattgtggccacaaagccattgtatgtagctttagctcagcgcaaagaagagcgccaggcttacctcactaacgagtatatgcagagaatggcaagtgtacgagctgtgcccaaccagcgagcacctccttcaggttacttcatgacagctgtcccacagactcagaaccatgctgcatactatcctcctagccaaattgctcgactaagaccaagtcctcgctggactgctcagggtgccagacctcatccattccaaaataagcccagtgctatccgcccaggtgctcctagagtaccatttagtactatgagaccagcttcttcacaggttccacgagtcatgtcaacgcagcgtgttgctaacacatcaacacagacagtgggtccacgtcctgcagctgctgctgctgctgcagctacccctgctgtgcgcacggttccacggtataaatatgctgcgggagttcgcaatcctcagcaacatcgtaatgcacagccacaagttacaatgcaacagcttgctgttcatgtacaaggtcaggaaactttgactgcctccaggttggcatctgcccctcctcaaaagcaaaagcaaatgttaggtgaacggctctttcctcttattcaagccatgcaccctactcttgctgggaaaatcactggcatgttgttggagattgataattcagaacttctttatatgctcgagtctccagagtcactccgttctaaggttgatgaagctgtagctgtactacaagcccaccaagctaaagaggctacccagaaagcagttaacagtgctaccggtgttccaactgtttaaaattgatcagagaccacgaaaagaaatttgtgcttcaccgaagaaaaatatctaaacatcgagaaactatgggaaaaaaaattgcaaaatctaaaataaaaaatgcaaaatctaaaataaaaaatggaaaggaaactttgaaccttatgtaccgagcaaatgcaaggtctagcaaatataatgctagtcctagattacttattgatttaaaaacaaaaaaaagattacttaattttgatttaaaaacaaaaaatcgtaaaatacaaaaaccagttaatgttttgtagaccctgggaaaagaattttcagcaaagtacaaaaatttaaagcattcctttaattttttaattctttactgtggaatagctcaaaatgtccattctgttttaagtaacagaattgataactgagcaaggaaacatggtttggattataaaattcttgctttaataaaaatttcttaaacagtgaaaaaaagaaaaatcatcaattttactaatagtctttctttacattttctattattctatctcccactatatttcaaatatgaaaatcactttttcaccaaaattttaggtctttacataatagtgtttatttttaatattcataaatgaaaatatgcaatgacaaaatagtaattataaattcagtaacatttgttcaaaattgtaagacaattattaatttatactgcattatttttaaataaaaaataaatacatagttttaaaaatctaattgaacaggaggctaaacatggttctgatcacagagataatcacttttaatcatttggttttagtgtttctggtagttgattttcttcaataataattgtacatagttatttcttggtttatcaattttgtaatttaactattgacttcctgctgtaacaaataaggatatgtttcatctacctcttcccaccatccctcctcctcctcccaatataatttatcactacttgtagctcctttattggtaatattaattaatataaatatttataattaatgttacacctagtgaattgtataaaaggacagcccatttgagcattctcctttaagatgagtagaggctgtgacattgcactacatagaaatataattataccatattactttgcaataaactatgtattatag

SEQ ID NO: 22889 - DNA, 3016 bp, Homo sapiens
gggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 22890 - DNA, 3048 bp, Homo sapiens
gcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccgggggtgagccgcccgcccggcccgccgtgccctccccccgctcgggccccgagccccgcgccccgcgcctgccccggcgcaccacgtgtccgtgctgcccttcgccgcccgcccggggctcgccgagtcggcgcccacaaagatttggtttccctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 22891 - DNA, 2753 bp, Homo sapiens
ctctgccccggcggttgtaatcttaaaccgccggagcccgaggcctatatttatagagaaacgcgtgtccccgaggccgccgtgggcagcgtccggtcgcctcttaaaggatttttacccttcggaaggggattccccgtttaatttttttcctactttgattttttgaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaaggtggtgtgtgatgagaacggctctaagggttatgcctttgtccacttcgagacccaagaggctgccgacaaggccatcgagaagatgaatggcatgctcctcaatgaccgcaaagtatttgtgggcagattcaagtctcgcaaagagcgggaagctgagcttggagccaaagccaaggaattcaccaatgtttatatcaaaaactttggggaagaggtggatgatgagagtctgaaagagctattcagtcagtttggtaagaccctaagtgtcaaggtgatgagagatcccaatgggaaatccaaaggctttggctttgtgagttacgaaaaacacgaggatgccaataaggctgtggaagagatgaatggaaaagaaataagtggtaaaatcatatttgtaggccgtgcacaaaagaaagtagaacggcaggcagagttaaaacggaaatttgaacagttgaaacaggagagaattagtcgatatcagggggtgaatctctacattaagaacttggatgacactattgatgatgagaaattaaggaaagaattttctccttttggatcaattaccagtgctaaggtaatgctggaggatggaagaagcaaagggtttggcttcgtctgcttctcatctcctgaagaagcaaccaaagcagtcactgagatgaatggacgcattgtgggctccaagccactatatgttgccctggcccagaggaaggaagagagaaaggctcacctgaccaaccagtatatgcaacgagtggctggaatgagagcacttcctgccaatgccatcttaaatcagttccagcctgcagcgggtggctactttgtgccagcagtcccacaggctcagggaaggcctccatattatacacctaaccagttagcacagatgaggcctaatccacgctggcagcaaggtgggagacctcaaggcttccaaggaatgccaagtgctatacgccagtctgggcctcgtccaactcttcgccatctggctccaactggtaatgctccggcctctcgtggcctccctactaccactcagagagtcgggtctgagtgcccggaccgcttggctatggactttggtggggctggtgccgcccagcaagggctgactgacagctgccagtctggaggcgttcccacagctgtgcagaacttagcgccacgcgctgctgttgctgctgctgctccccgggctgttgccccctacaaatacgcctccagtgtccgcagccctcatcctgccatacagcctctgcaggcaccccagcctgcggtccatgtgcaggggcaggagccactgactgcctccatgctggctgcagcacccccccaggaacagaagcagatgctgggagaacgcttgttcccactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgattcaaaagccaaataaccccttatggaattcaactcaaggtttgaagacttcctagcttgtcctatggacctcaacaccaaggattacaaattgcaaatttaataggtcattttgtatcaaaaggtcaattatgaagcacctagaatttttcaattatacgaatatgttctttgggttctgctgtggcccagacagtgttaactttttttttattgtgggttttgattttttcccccagaaattggttttatttgatgtacccaagtcttacgtttcccaataaagaaaaaaaatctccataaaa

SEQ ID NO: 22892 - DNA, 898 bp, Homo sapiens
ctctctccgccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccggggcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtccatccgggtctgccgcgatatgatcacccgccgctccctgggctatgcctacgtcaacttccagcagccggccgacgctgagcgggctttggacaccatgaactttgatgtgattaagggaaagccaatccgcatcatgtggtctcagagggatccctctttgagaaaatctggtgtgggaaacgtcttcatcaagaacctggacaaatctatagataacaaggcactttatgatactttttctgcttttggaaacatactgtcctgcaag

SEQ ID NO: 22893 - DNA, 352 bp, Homo sapiens
cactcatccaaacaatgcattcaaatctggctgggaagatcacgggaatgctgctggagatagacaactctgagctgctgcacatgttagagtcccccgagtctctccgctccaaggtggatgaagctgtagcagttctacaggctcatcatgccaagaaagaagctgcccagaaggtgggcgctgttgctgctgctacctcttagacaaggaaaaaccgtatgtgtggctattttcatttttgttcctatgagcattgttcctatgagcattgtctttgtggtttgacctgaggttgtatatatgctcactgcttagctctgggaatacaataagtacagttagttacacg

SEQ ID NO: 22894 - DNA, 634 bp, Homo sapiens
tctccgccccgggtcgctgccgcctccgccgctttcgggcttcgcagcctgaggaaaaaaagagaaaaagataaaaaaaatctgaaaacgcttcaaaatcctgaaaaaaaaaaaggaaaagaaaaaacgaatcctcggagaacccgcggggaagtcactttcgtacgcttccggcctgccccgcgcccgccgccgcagcgcttggcgtccgtcggtctccgtccgtcggtccggggaaatttggagcttcgcaccaggaccgcggagaagtgcaaagtcgcggggagggccgtattgtgcggagagccttttgtctgcggtgctgcggccgtgggagccggcccccgcctcccgtttccgtcccgtctccaagcccgccgactccagctcgtcctcgccgcgccggtgccacctgtgagccgcggcgcgggcccgggctccgaaggcgcccctttgtcctgcggcgggcccgataagaagtcctcctggcggggctcggggtggtggggggcggggagatgaacgctgcggccagcagctaccccatggcctccctgtacgtgggcgacctgcattcggacgtcaccgaggccatgctgtacgaaaagttcagccccgcggggcctgtgctgtc

SEQ ID NO: 22895 - DNA, 3221 bp, Homo sapiens
gcgcgtttgccagtcagtctctccggacctgcctcgagcctcaggctgctgaaatcaccgcgcctcactcgcctcgacagtgattctgagtctgcttttagcttccttttgcctgccttggctttttctgttcgtgaacagctgtttggcccatagcttagagaaagcagccttttttctcttcaaagagaacctcctcccagtgctcagagagatggggagcggggagcctaatcctgctggcaagaaaaagaagtatctcaaggccgctctgtacgtgggtgacttggacccagatgtcaccgaggacatgctctataagaagttcaggcctgctggccctctgcgattcacccgaatctgccgtgatccggtgacccgcagccccctgggctatgggtatgttaacttccgctttcccgcggatgcagagtgggccttgaacaccatgaattttgatttgattaatggaaaaccattccgccttatgtggtctcagccagatgaccgcttaagaaagtctggagtgggaaatatattcatcaaaaacctggacaaatccatagacaatagggccctgttttacttattttctgcttttgggaacattctgtcctgcaaagtcgtatgcgatgacaacggctctaagggttatgcctatgttcactttgacagcctggccgctgccaatagagccatctggcacatgaatggagtgcggctcaacaaccgccaggtgtatgttggcagattcaaattcccagaagagcgggcggctgaggtcagaaccagggatagagcaactttcaccaatgttttcgttaaaaacattggagacgacatagatgacgaaaaactgaaggaacttttctgtgaatatgggccaactgagagtgttaaagtaataagagatgccagtgggaaatctaaaggctttggatttgtgagatatgagacacacgaggctgcccaaaaggctgtgctagacttgcatggaaagtccatcgatggaaaagtcctctatgtagggcgagcacagaagaaaattgaacgcctggctgagttgaggcggagatttgaacggctgaggttaaaagaaaaaagtcggcccccaggggtgcctatctatattaagaacttggatgagacaatcaatgatgaaaaactgaaggaggaattttcttcctttgggtcaattagtcgggccaaagtgatgatggaagtggggcaaggcaaaggatttggtgtggtctgcttttcctcttttgaagaggctaccaaagcagtggatgagatgaatggccgcatagtgggctccaagcccctgcatgtcaccctgggccaggccaggcgcaggtgctgagaataagaatgctcagtttgtttcagccttagttggtgcctccttagtttgggctcctttgtgataaggggttattttatgctaattcacaagtttttttttgaagtgaattcttttgaaaaaaaaatgcaaaactagaaaactttattcattttagaatagaacataatttctaactgtaaaattgtcattttgtactttttttgatgtaatatccttagaaatctgtagaataaagtgtattcctccacttttttttcctgaacagtcaaggtgaggcaattgattgagtatatttcccttcttatttcagtaatactctattttttttcatgaaaatgtcaacatggttcttctgaatctatcacagtgaaaagttctaacttgtttttgagaagtcagtacagcaggggaaaacatatgtgatgcaattaacatctgcataatttcacttaaaattattatgcaaaaatgaatgttttttcaaaaaatgtgaaatgtattttattttctttatttgtattcttgtttcattttttaatatgttgtgaacatgctacagatttgatagtacttttgactaaatgttgggagtggtcgtattaacttcttgcccaaagaagtaagcatattggtgttttctcaattagtcactgagaaaattaacactttaggcagtggctatttaaagtaggaattgcatcttaaaaacctttcctaagagatttggtatgtgaggatactttcagtaccactcctaccattcatttttctaaattccttagtacatatacttggatcatgttaaattaacaagaaagatgaataactgcgctgaattgcctttacctataaataatttaatattttaccttcgggttttatcaactgtcaatataaaaggcagtactccacagaatgatgttgaaaaacttcttcgaagaacaccttctattaaacttgttatctcttgtaaattattgtgtgtgtccttttgataatattcacaggtgtttcaaaggtaaggaataggttgtctcttggattaagtcatatgcctccagccattatatgagaactgtgaaaccaatatggttttctttatgtcttggctgcttgaaaattaaaaaaaaaaaaggtttgttcaatattgccgttacatttattagcctgtaatttctaaattggagattctctacatttcacttgcagtttcctgttctcctcattgcctgccttccattcatattacacttatttttctattttttgtattacctttttaaaaatatataccagttcaagtccttttaggaagaagaaaatacctaatttatgtaaaatttaaataattacttttttataatatgattcacttatgccacagattcaacattagaatatgttttatctctactgtcagttttattaccttatatacaaatcttcattttcatacatagtacaatgtaaatatataactttgttaacacttttgttagctctttgaccataaaataatgacaataagctgtttctatgtatttgtttatctacaaattacaggtttatccatttgcaaatattttcaaaatggaaatcactgtttatattgattataaacataagacatgctcattgtaaaaaatgtacacaaggcagaaggaagtaaaatttccacagttcagaaataccacaattaatattttcaatgtgtaaatatcttttcataatttttcctacgtatacacaaacattttgaccaaaaatccacactatatgtactgttctgtatttttaattttaaactgaacaataatcatcttttcctgacaataaatatcaatctctatcatca

SEQ ID NO: 22896 - DNA, 1262 bp, Homo sapiens
cagaggaagcgggaagttacttagcacggttccgggtttctcgcgccccgcctgtcccccctccctatcactgctactggctcttggtccctccgttggactgtcctgcggagagaaaccccagcccatcggtctgcgctgggaccgcccgccgcgcatctgcccttcttcgctgactccgccccgcatctggccagacccgcctcgcgtcagagctgacccactcactgcgcgtttgccagtcagtctctccggacctgcctcgagcctcaggctgctgaaatcaccgcgcctcactcgcctggccgctgccaatagagccatctggcacatgaatggagtgcggctcaacaaccgccaggtgtatgttggcagattcaaattcccagaagagcgggcggctgaggtcagaaccagggatagagcaactttcaccaatgttttcgttaaaaacattggagacgacatagatgacgaaaaactgaaggaacttttctgtgaatatgggccaactgagagtgttaaagtaataagagatgccagtgggaaatctaaaggctttggatttgtgagatatgagacacacgaggctgcccaaaaggctgtgctagacttgcatggaaagtccatcgatggaaaagtcctctatgtagggcgagcacagaagaaaattgaacgcctggctgagttgaggcggagatttgaacggctgaggttaaaagaaaaaagtcggcccccaggggtgcctatctatattaagaacttggatgagacaatcaatgatgaaaaactgaaggaggaattttcttcctttgggtcaattagtcgggccaaagtgatgatggaagtggggcaaggcaaaggatttggtgtggtctgcttttcctcttttgaagaggctaccaaagcagtggatgagatgaatggccgcatagtgggctccaagcccctgcatgtcaccctgggccaggccaggcgcaggtgctgagaataagaatgctcagtttgtttcagccttagttggtgcctccttagtttgggctcctttgtgataaggggttattttatgctaattcacaagtttttttttgaagtgaattcttttgaaaaaaaaatgcaaaactagaaaactttattcattttagaatagaacataatttctaactgtaaaattgtcattttgtactttttttgatgtaatatccttagaaatctgtagaataaagtgtattcctccacttttttttcctgaacagtcaagg

SEQ ID NO: 22897 - DNA, 1671 bp, Homo sapiens
agtctctccggacctgcctcgagcctcaggctgctgaaatcaccgcgcctcactcgcctcgacagtgattctgagtctgcttttagcttccttttgcctgccttggctttttctgttcgtgaacagctgtttggcccatagcttagagaaagcagccttttttctcttcaaagagaacctcctcccagtgctcagatgtcaccgaggacatgctctataagaagttcaggcctgctggccctctgcgattcacccgaatctgccgtgatccggtgacccgcagccccctgggctatgggtatgttaacttccgctttcccgcggatgcagagtgggccttgaacaccatgaattttgatttgattaatggaaaaccattccgccttatgtggtctcagccagatgaccgcttaagaaagtctggagtgggaaatatattcatcaaaaacctggacaaatccatagacaatagggccctgttttacttattttctgcttttgggaacattctgtcctgcaaagtcgtatgcgatgacaacggctctaagggttatgcctatgttcactttgacagcctggccgctgccaatagagccatctggcacatgaatggagtgcggctcaacaaccgccaggtgtatgttggcagattcaaattcccagaagagcgggcggctgaggtcagaaccagggatagagcaactttcaccaatgttttcgttaaaaacattggagacgacatagatgacgaaaaactgaaggaacttttctgtgaatatgggccaactgagagtgttaaagtaataagagatgccagtgggaaatctaaaggctttggatttgtgagatatgagacacacgaggctgcccaaaaggctgtgctagacttgcatggaaagtccatcgatggaaaagtcctctatgtagggcgagcacagaagaaaattgaacgcctggctgagttgaggcggagatttgaacggctgaggttaaaagaaaaaagtcggcccccaggggtgcctatctatattaagaacttggatgagacaatcaatgatgaaaaactgaaggaggaattttcttcctttgggtcaattagtcgggccaaagtgatgatggaagtggggcaaggcaaaggatttggtgtggtctgcttttcctcttttgaagaggctaccaaagcagtggatgagatgaatggccgcatagtgggctccaagcccctgcatgtcaccctgggccaggccaggcgcaggtgctgagaataagaatgctcagtttgtttcagccttagttggtgcctccttagtttgggctcctttgtgataaggggttattttatgctaattcacaagtttttttttgaagtgaattcttttgaaaaaaaaatgcaaaactagaaaactttattcattttagaatagaacataatttctaactgtaaaattgtcattttgtactttttttgatgtaatatccttagaaatctgtagaataaagtgtattcctccacttttttttcctgaacagtcaaggtgaggcaattgattgagtatatttcccttcttatttcagtaatactctattttttttcatgaaaatgtcaacatggttcttctgaatctatcacagtgaaaagttctaacttgtttttgagaagtcagtacagca

SEQ ID NO: 22898 - DNA, 2001 bp, Homo sapiens
cgggatttgagaatttggcgcagtgccccgccttagaggtggggccttatttgattgccaagtaatattccccaatggagtactagctcatggtgacgggcaggcagcttgactaatgagtcctcggcgtggccggcgcagctctccaatcgccgggcggcgggccccagtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggggccgggctagagcgacatcatggtattccccttactaaaaaaagtgtgtattaggaggagagagaggaaaaaaagaggaaagaaggaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggtttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgttttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataaaaattgtttggccttttgggtgtaa

SEQ ID NO: 22899 - DNA, 2768 bp, Homo sapiens
agtctgagcggcgatggcggcggcggcggcggcggcagcagcagcgggggctgcgggcggtcggggctccgggccggggcggcggcgccatcttgtgcccggggccggtggggaggccggggagggggccccggggggcgcaggggactacgggaacggcctggagtctgaggaactggagcctgaggagctgctgctggagcccgagccggagcccgagcccgaagaggagccgccccggccccgcgcccccccgggagctccgggccctgggcctggttcgggagcccccggcagccaagaggaggaggaggagccgggactggtcgagggtgacccgggggacggcgccattgaggacccggagctggaagctatcaaagctcgagtcagggagatggaggaagaagctgagaagctaaaggagctacagaacgaggtagagaagcagatgaatatgagtccacctccaggcaatgctggcccggtgatcatgtccattgaggagaagatggaggctgatgcccgttccatctatgttggcaatgtggactatggtgcaacagcagaagagctggaagctcactttcatggctgtggttcagtcaaccgtgttaccatactgtgtgacaaatttagtggccatcccaaagggtttgcgtatatagagttctcagacaaagagtcagtgaggacttccttggccttagatgagtccctatttagaggaaggcaaatcaaggtgatcccaaaacgaaccaacagaccaggcatcagcacaacagaccggggttttccacgagcccgctaccgcgcccggaccaccaactacaacagctcccgctctcgattctacagtggttttaacagcaggccccggggtcgcgtctacaggtcaggatagatgggctgctcctctttcccccgcctcccgtgagccccgtatgcttcctcctctctggtctgaggaacctccctccccccacccctccccgtggtcttcaggaactttgtctcctgcctgtgcaggttgaggaaggtagttgcaggccaggccagaaggccagcctcatcatcttttctgcagtagaaattggtgataagggctgcatccctcccttggttcaaagaggcttccacccccagccttttttttcttgggagttggtggcatttgaaggtgtttgcggacaaaactgggaggaacagggcctccaggcagtgaaagcactgcttggacatttgttacttttttcggagttagggagggattgaagactgaacctcccttggaagaataccagaggctagctagttgatcctccccaacagccttgtgggaggattttgagatacttattctttatttgagccagtcttgcaaggttaacttctcactgggcctagtgtggtgcccaggtttttgccttgcttcacttctgtctctacatttaaatagacgggttaggcatataaaccttggcttttcataagctctacctgcctatccccaggagttagggaggatctatttgtgatggcctagggtttaagagctgtggaggactgaaaactggataaaaagggggtccttttccttgcccctgtctctcactcagatgcgcttctttttcgccactgtttggcagttttctgttaagcccccctccccctgccccagttctccaggtgcgttactatttctgggatcatggggtcagttttaggacacttgaacacttcttttccccccttcccttcacagtaactggggcaggggcctacggggaggggcttgtactgaactatctagtgatcacgttaacacctaactctccttctttcttccaggggccgggctagagcgacatcatggtattccccttactaaaaaaagtgtgtattaggaggagagagaggaaaaaaagaggaaagaaggaaaaaaaaaagaattaaaaaaaaaaaaaagaaaaacagaagatgaccttgatggaaaaaaaatattttttaaaaaaaagatatactgtggaaggggggagaatcccataactaactgctgaggagggacctgctttggggagtaggggaaggcccagggagtggggcagggggctgcttattcactctggggattcgccatggacacgtctcaactgcgcaagctgctgcccatgtttccctgccccacttcacccccttgggggctgctcaagggtaggtgggcgtgggtggtaggaggtttttttttttacccagggctctggaaggacaccaaactgttctgcttgttaccttccctccgtcttctcctcgcctttcacagtcccctcctgcctgctcctgtccagccaggtctaccacccaccccacccctcttctccggctccctgcccctccagattgcctggtgatctattttgtttccttttgtgtttctttttctgttttgagtgtctttctttgcaggtttctgtagccggaagatctccgttccgctcccagcggctccagtgtaaattccccttccccctggggaaatgcactaccttgttttggggggtttaggggtgtttttgtttttcagttgttttgtttttttgttttttttttttttcctttgccttttttcccttttatttggagggaatgggaggaagtgggaacagggaggtgggaggtggattttgtttatttttttagctcatttccaggggtgggaatttttttttaatatgtgtcatgaataaagttgtttttgaaaataaaaa

SEQ ID NO: 22900 - DNA, 4519 bp, Homo sapiens
agcagttctagaacgttgctgtggtagcgctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggatgaaacaagtgaagatgctaactgtcttgctttgagtggacatgataaaacagaagcaaaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgtatttttcattagaaagtagaactaattttagattttcagcttgatggattttcagtttttcctgaagaattttctttaccattagtcttcaaattggatactgttgtgcagtggtgtactgttatacttcagagaaagggtaagagtacatctagttcagttcctatgaggtagctgtaacccttaaaaatgaaacgtcaactctagggtacatttgacattgaaagaatagttaggaaataacttggttttgatagggtcatgattaagaaatgatatattggttttatttatggaattgttttatagtgcatacaaatcagcgatcagccagcaaatatttttctttgagcttgtgaaagctctgtgttcttttgccttcaatctgttgtcttcaaaacaaacaaacaaaaaaagcttcttgcgcctttccctcccctgttttcttcctttttctttttgcttgtatgcacaaggtaggacttacttcgtaagaaacaaaatgccagtattttcttaagccatgatgtgaaaccaatgaccctgtgaccacatggcacagaacactaaattttggtcccatggctgaaacttgagggtgactaaaagtaatgcctgtgaaacatgatatctatctgggatggccatttgatctctaaaaggaattttgtacactccacagaactcctatctatagtaaaattgattttcagttttaaatgtgggcaaaaaggcattttctccaagattttaaaactaattcttatttttaaatggtttaccaaaatttgtcagtacattttacgtgtagaagcattttaaaaatcatttctagcaagcacttgacatctagtcagctctctactcctttattttgttttatcaaaagattaagagctcctttctttgaataaaataatttctcataattaagcagtagaagatctatcttcacaaagtatgagggatgccagatgttgataaacttactctttctgaatctggacaaagtcgacttaacagatttttctgatgagcatgttttatgaatcctccattgtgctccattctatcacatgtgcatttttcatgttaaactgcaattacttaatctcttcccctatccttctaaattaattttctgaagttggagtgtagtcttttcccccttaggctatgcattaatcgaagctttcttttcaccatgactttataatgtctagtaaacaatatttctacttcccacatctttgctttacacagtcaccttgcccttccttccaccaccgaagaaaaaagatggtcatactaacaggtgaaatgtacaaggtgtctgtgtgttttgtgtagcttcagagttagattgaaattaccaggcacagatttagtcttgtcattttgtttacacattggggaaaacaattcagtttattaaacgtttcatgtaactgcacccaagttttgccaagctggaaacttggaccttttctgtgtagtgactttttaattatagttttcataacctggagatcagactgttgctttcgcatgatgtatgtagtgtctcatgactggagtttgctttgttttatagtatctgtactccttgtatttttcaagagctattttgtaaacagatgatgtatttctccattgaaaacacaataaaaaaaaaacagcacaa

SEQ ID NO: 22901 - DNA, 2601 bp, Homo sapiens
atgttaggacgaaggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatgggaatggccaaatccagtgctattgaaacagcctgaagaatgcaatcttaatttgcctgtatgggacccaagggtaaaccccagtgataggtaccatcttatgcctataattacaccagcatacccacaacagaactccacgtacaatgtgtccgtttcaacacggatggtcatggttgaggagtttaaacaaggtcttgctatcacagatgaaattttgctgagtaaggcagagtggtccaaactttttgaagctccaaacttctttcaaaagtacaagcattatattgtacttctagcaagtgcaccaacagaaaaacaacgcctggaatgggtgggcttggtggaatcaaaaatccgaatcctggttggaagcttggagaagaatgaatttattacactggctcatgtgaatccccagtcatttccagcacccaaagaaaatcccgacaaggaagaatttcgcacgatgtgggtgattgggttagtgtttaaaaaaacagaaaactctgaaaacctcagtgttgatctcacctatgatattcagtctttcacagatacagtttataggcaagcaataaacagcaagatgtttgaggtggatatgaaaattgctgcaatgcatgtaaaaagaaagcaactccatcaactactacctaatcatgtgcttcagaaaaagaaaaagcattcaacagaaggtgtcaaattgacagctctcaatgacagcagcctcgacttgtctatggacagtgataacagcatgtctgtgccttcacctactagtgctacgaagaccagtccattgaacagttctggcagctctcagggcagaaacagtcctgctccagctgtaacagcagcatctgtgaccaacatacaggctactgaagtttctgtgccacaagtaaattccagtgaaagctcagggggtacatcgagtgaaagcattcctcaaactgccacacaaccagccatttctccaccaccaaagcctacggtctccagagttgtttcttcaacacgtctggtaaacccaccacctagatcttcaggaaatgcagcaacttcaggaaatgcagcaacaaaaatacctactcctatagtaggagtcaagaggacatcctcacctcataaagaagagagtcccaagaaaaccaaaacagaagaggaacaacttgatacagagacaagtacaactcaatcagaaactattcagacagcggcttctctgttggcctctcagaaaacatccagtacagacctttctgatatccctgctctccctgcaaatcctattcctgttatcaagaattcaataaaactgagattgaatcggtaaaaacaacctcaggggtccataaacaatatctgccaactcaacctgttgtcttcaaatgctaaaaaaggagaatggagggtacaagactagacatgactgaaatggatttgggttttttggtgacctcccttactgggctaatcagcacttgatcggaagtccaggttagtatgtgaagccaggagtactattattattgtgttagcaacagttgcattaactatttcaaaaattactgcctttaaaaaaaacaacctcaagctatatttgtattcataattgacatctggattgggtttatgtttgatgcattgtttggaaaatttgcaatacaaactggcataagaattacttattctgatgatgcacttttatgta

SEQ ID NO: 22902 - DNA, 3264 bp, Homo sapiens
gctcgggcgccatgttaggacgaaggggaaggaggagaagcgcttaaagcggcgggagcggtgcgggagaggggttggacccagggctgaggcaggcccccccctccctcccgcctcagtggatcatgcccagggcggcagcggcggcggttgcgggggggaagtgactgggcggtgccggcgccggagacgatgccgtttccagttacaacacagggatcacaacaaacacaaccgccacagaagcactatggcattacttctcctatcagcttagcagcccccaaggagactgactgcgtacttacacagaaactaattgagacattgaaaccctttggggtttttgaagaggaagaggaactgcagcgcaggattttaattttgggaaaactaaataacctggtaaaagagtggatacgagaaatcagtgaaagcaagaatcttccacaatctgtaattgaaaatgttggaggaaaaatttttacatttggatcttacagattaggagtgcatacaaaaggtgctgatattgatgcgttgtgtgttgcaccaagacatgttgatcgaagtgactttttcacctcattctatgataagttgaaattacaggaagaagtaaaagatttaagagctgttgaagaggcattcgtaccagttattaaactctgttttgatgggatagagattgatattttgtttgcaagattagcactgcagacaattcctgaagatttggatctacgagatgacagtctgctaaaaaatttagatataagatgtataagaagtcttaacggttgcagggtaaccgatgaaattttacatctagtaccaaacattgacaacttcaggttaactctgagagctatcaaactatgggccaaacgccacaacatctattccaatatattaggtttcctcggtggtgtttcctgggctatgctagtagcaagaacttgccagctttatccaaatgcaatagcatcaactcttgtacataaatttttcttggtattttctaaatggtatgtgtttagattatattaaaataaaattgattgtagacactgaagtttagtcttatttctatgacatttctcagcttggtttcagattcaaattttagttcatgatgtagtcatgtaggcagccttggagatcacattgtgtataaaatggcaaactgaaactattttttttccctagtttggccaggatagtaaggcagattctatttgtacttccttgcataaacttaccctctgaataaactctgaattttagcagctaagatccaatttattgataggttgggaaatcagttactatacttttggataaaacttgtacacactacctctttcactcttttaattctctatctataggccattagtttcttgtgattgttttttttttctttttgctttcagcatttatttggcctaatattaaagatacgaattttcataagaagcttttaaagaataaattaacattaagtgcttcgggacaaaaaaggaatttgagattagtcattaacccagatttttttaagtttcttcgtttcatttccacatatgtcaactatgatttaagaaaaagtagaataaaagattactgccattttatattaattgccttggcccaaaaggtgagggttcttggtttttaatcaaattaagataaatcgtccattcctgttcttatgaactcctgctcctccctctgcaaaagagatgttcttttctagtaattttataaaaattagttatttgagacaatttagagctgtgttcaactggaggaaaaataaaaaaaatttagaaccatgccacacttttcagtacacattctggctgttttgggatttagtagcacttataatcaggtgtgataagattaaagaatgtcagaatttcttttttttttttttttttttttgtttgagacggagtctcactctgtcacccaggctggagtgcagtggcacgatcttggctcactgcaagctctgcctcctggattcatgctattctcctgccttagtctcctgagtagctgggactacaagcgcctgccaccacgcctggctaatttttgtatttttagtagagacgaggtttcactgtgttagccaggatggtctcgatctcctgacctcataatccgcccgcctcggcctcccatagtgctgggattacaggcgtgagccaccgcgtccggctgtcagaatttcttttaatgctacacatatataagcaaataatgtttttaagaagctaaccttgatgttaagagtggcaggtgttctccagtttttacctctttcatatgggaccaaagtagctagtttatggaacacatatgaaaatgtggttatgccaccaagttttactactacacttgtcttaccacttttaagtcatgaattctataattattcatacccctttgcctgtgatcagaagtaacttttaaaattatcacttgactttggatggaactagtataaaggcaggaattttgtctttcagtggagatttattctgttcaaggttgaagtggacacatcattatcttgggatggtacttctttatttaaatagtcctttaaagttctttgagtggcagagaacgtttttggtttcagtctgagaaggctaccaaatggtttaagttcatttcatagttaggagaaaaagattttgagtagtctaatgtcgtcagaaaggattaaaacgttgtatgtaccaagaaggcagaatgaagaaggatcacgttcacaaatgctgtatgtttaacaaaatacgtttagatggtaatatccaatagtcttatcaagtgctacaatctttttaaacagggaatggccaaatccagtgctattgaaacagcctgaagaatgcaatcttaatttgcctgtatgggacccaagggttagtgtattattttttcccctaccaattcacactgtgcaataacaagtaaaaatcatctgcataaactccagggagacttccagccttttacttatgaatggtcatgtccgtattacactttcttttagataacctcaactataattgtcctcaactataattgatgtgagaagcataattatgtaccctgtaaaccacatttaattgtacatagtttttaatacagattttactaacattttaatttattctatatagaactaccttgtaagtcaaagttgtgtgggcatttgtgctttaaaaaaaataaaaggatact

SEQ ID NO: 22903 - DNA, 4262 bp, Homo sapiens
atgttggggctgaggggaaggaggagaagctcctgaagcggcgggcgcgcagcgggagtgggagtggggtcggaccagggcagctagaagccctgcccttccgcctcagcggatcatgacccgggcggcggccgcgaaggtcgcggtggtgggggacgtgccctggcggggcgggcgctgaaagatgatgccgtttccggtgacaacccagggaccaccgcagccggcgccgccgccgaatcgctacggcgtctcctcgcctatcagtctagcggtccccaaggagacggactgcctcctcacccagaggctaatagaaaccctcaggcccttcggggtcttcgaagaggaagaggaactgcagcgcaggattttagttttggaaaaattaaataatctggtaaaggaatggatacgcgaaatcagtgaaagcaagagtcttccccagtctgtaattgaaaacgttggaggaaagatttttacgtttggctcttacagattaggagtacatacgaaaggcgcagatattgacgccttgtgcgttgcaccaagtcatgtggatcgaagcgactttttcacctcattctatgctaaactgaaactacaggaggaagtgaaagatttaagggctgtcgaggaggcatttgtgccagttatcaaactgtgttttgatgggatagagattgatattttatttgcaagattagcactacagactattccagaagatttggacttaagagatgacagtctacttaaaaatttagacattagatgcataagaagccttaatggttgccgggtaaccgatgaaattttacatctagtgccaaacattgacaacttcaggctgactctgagagccatcaaactgtgggccaagtgccacaatatctattccaatatattaggtttcctcggaggtgtttcctgggccatgctagtagcaagaacttgtcagctttatccaaatgcagtagcgtcaactcttgtacggaaattcttcttggtattttcagaatgggaatggccaaacccagtgttactgaaggagcctgaagaacggaatcttaatttgcctgtatgggacccaagagtaaatcccagtgataggtaccatcttatgcctatcatcacaccagcatacccacagcagaactccacatacaacgtgtctatttcaaccaggatggtcatgattgaggagtttaaacaggggcttgctatcacacacgagattttgctaagtaaggcagagtggtccaaactctttgaagctccaagcttctttcaaaagtacaagcattatattgtacttctggcaagtgcatcaacagaaaaacaacatttagaatgggtgggcttggtggaatcaaagatccgaatcctggttgggagcttggagaagaatgaatttattacactggcacatgtgaatccacagtcatttccagcacccaaagaaaatcctgatatggaagaatttcgtacaatgtgggtgattgggttagggctaaaaaagccagataattctgaaattctcagcattgatctcacctatgatatccagtctttcacagatactgtttataggcaagcagtgaatagtaagatgtttgagatgggtatgaaaattactgcaatgcatttaagaagaaaggaacttcaccagctgctgcctcatcatgtgcttcaggacaagaaagcacactcaacagaaggtagaagattgacagatttgaacgacagcagctttgacttgtctgcaggctgtgaaaacagcatgtctgtgccttcatctactagcactatgaagacaggcccattgattagcagttctcagggtagaaacagtcctgccttggctgtaatgacagcatctgtggctaacatacaggctactgaattttccttgcaacaggtgaataccaatgaaagttcaggggttgcattaaacgaaagtattcctcacgctgtctctcagcctgccatttctccatcaccaaaggccatggtcgccagagttgtttcttcaacatgtctcataagccatccagaccttcaggaaactcagcaacaaacatatctaatcctatagttggagtctagaggatattcttgcctcataaagaagaaaggaccaagaaaaccaaaacggaagaggagaaactcaatacaaagacaagtacaactccattagaaaaattcagacagcatcttctctattggcctctcagggaacatcagtatagatctttccggtatccctgttctccctgcaaatccaattcctgttatcaagaattcagtaaaacaggttgaatggttaaaaacaacctcaagggtccatgaacaatatctgccaactgaacctgttgtcttcaaatactaaggaaggagaatgaggggtacgggactagatatgacttgaaatagattgaggctcatttggtaacttcctttactgagccagtcttgatcagaagtccacattagtatgtgacagctagaggtactgttattaatgtatcagcaacagttacattaactatttcaaaggactactgcccttaaaatgaaaaaacctttcagctatgtttgtacccgtgactgacatctggactggatttatgcttgatgcattgttgggaaaatatgcaatacaaactggtatcagaattccttatactgatgaggcactttatattttttattagaaagtagaactaattttagatttttcaaattggtgaattttatttttccctgaagaggtttcttcactattaatcttaaaattggataccattgtgcagcggtgtactgtacttcagagaaagcataaaagtacatctagctcagtccctatgaggtagctgtaaccctttaaaatgaaatgtcaactttaaggtatgtttttgacatcaaccattagtaggtctttggttttgatggcacactatggagaaaggacacactggttttaatctgtagaactgttttagagtaattagcaatcaaacattttctttgagctatcaaagctccatattctcttgtcctcaatcattagtcctaaaacaaaaaagctttttgcctccctctcttctctttgcctgtatgcacacagtatgcttatgtgtcatttcacaagaaaaaaggaataatattctctaaaccatgatgtgaaactgacaatcctgtggccacatggcacaaaacaccaaatattggttatgatgaaacaccacattttagcaaaactttactaaatgtaatgtctatgagatatgtttctgatcttggatgaccatttgatcactgcatatgagaagttttgttcattccacagaatacctccttataggaaagttaatttccaattgcacacataagcaaaaaggcattttcttcaagaattttaaacacttttatttttaaacgatttatcaaaattcatctctaaattttacatgtagaaacataaaaaagtaatttctagcaagcacttgacatcttactggctttctgctcttttagtctacaaaagatcagcaatactttaagttaaaaaaaatctcataattaagcagtagagcatctatgattaggaaatgtgaggggcaacagatgtgaatgaatgaaagttgagtctttcttaatctagacagcaaacttaacaggctttccaattagccttgctttaacccctcccgtccctcctctaactctgcacttttcatgttaaactgcaattacttaaactcttttcctgtcctgcattaattttccaaagttggaatatagtcatgtccttttatgctgtagagacttttctttcaccattactttctgatatctagtacacagtatttctttttctcacatctttgccgtttcaccacaataataaatcgggtgaagtgtgcacaatatctgtattttgaatggctatggcgttaggttgaaatggccaggcacaaatttagtctggtcattttgtttacacattgggaaaaaaattagtttattaaacattacctgtaactgtgtctgttttaccaagctggaaccttgggactttttatttctaatttttattacctgaatgtcagaccattttttcatgtgatgtacctagtgagtggagtttgctttgttttatggtatctgtactcctggtatattcaagcactgttttgaaaacagatgacttatttctccattaaaaatgcaataaaaataaatggcaaacaagcaaa

SEQ ID NO: 22904 - DNA, 2990 bp, Homo sapiens
gctgtttccggaagtcgcggccggcgtcaccgctgcggctgcctcagctactgccgcagtcgccgcggaattcgattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagg

SEQ ID NO: 22905 - DNA, 2360 bp, Homo sapiens
tttccggaagtcgcggccggcgtcaccgctgcggctgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcag

SEQ ID NO: 22906 - DNA, 3077 bp, Homo sapiens
gcgcgctgtttccggaagtcgcggccggcgtcaccgctgcggctgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaagtatataacgaagtcatttaacttctatgttttcccgaaacccttcaatagatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaagtatccgaaaggcattcatgttgagactttagaaactgaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagagccggctggcacatttggaagccgcactgtatttaacttaatcaaatgtggtatgggaggggttggaaaccaagttgtctcctgggggggagaaaacaggttttatttttgtggctgtggttttttcccctttttaatctaactgcctgttgacattgacactcatcacggttgtaggctgtcatgaatgtgtacgtgcttaaccagtgaattccgtgttgctcttgtgaggcctttcctgtcatgacccagtgtgcttaagaacctgcctgatggggagtgtcggctgtgaaatctgcaaaaagagctgacattccagctgctgtgatcatgaatttgggggtgtactgtcctgcctgtgcatcttctcgcactgagattttgaggcagttgcagccctcggttagtctcccagtggaaaaatcggttgtgcctccctgcttcccaccatagctgcctgaaaacatgacgctctcaagcttgtccttccttcaggaagatgtccactcatgcccacccatgagagggcttgccgtatgccctggcctttgggcatatttatgtagagttcctttctcctaagacgtgagtttctcatgggggatgtacgagtaaaaaggttaacttctgttcttatgcgtggcgctgtgttcactttccagagtctctgttcgtttgtttggatggcggtctcggggtacggcagcgtgtgtgcgtacgtgtctgtgtgtgtgtgtgtgtgtgtgtgtgtgtgtgtgtgtgtgtgtgtgtgaaatcgtgcaaatctacaacatgtcccagcccattctccgttgaaacagatcacagcaacgacaaacgctcatggcgctgctttgctccacccgcttcagatagatcattgttagatatttcacatttttgtatggtggaaataaaaatgaaaaatgtatttccaaaagatgaaaattaaaaacattttcatagg

SEQ ID NO: 22907 - DNA, 808 bp, Homo sapiens
agctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagcattccatggactttttgctatttcagtttggcctttgcacttttaagtatgactacacagattcaaaatcctcaccagatgtcaaatttgtttgtcagagctccagcattgactttctagcaagccagggatttgattttaataaagtttttcgaaatggaattccatatttaaatcaggaagaagaaagacagttaagagagcagtatgatgaaaaacgttcacaggcgaatggtgcaggagctctgtcctatgtatctcctaacacttcaaaatgtcctgtcacgattcctgaggatcaaaagaagtttattgaccaagtggtagagaaaatagaggatttattacaaagtgaagaaaacaagaacttggatttagagccatgtaccgggttccaaagaaaactaatttatcagactttgagctggaaaaggagcgatatatagttatcagcaaagtagatgaagaagaacgcaaaagaagagagcagcagaaacatgccaaagaacaggaggagctgaatgatgctgtgggatt

SEQ ID NO: 22908 - DNA, 1557 bp, Homo sapiens
gtcaccgctgcggctgcctcagctactgccgcagtcgccgcggaattcggcgagtagaaccgctgaggcgggcgcgggcccgggtggggccaaggttccggccactctgcagaatggagataatcaggagcaattttaagagtaatcttcacaaagtgtaccaggccatagaggaggccgacttcttcgccatcgatggggagttttcaggaatcagtgatggaccttcagtctctgcattaacaaatggttttgacactccagaagagaggtatcagaagcttaaaaagaaggagcgatatatagttatcagcaaagtagatgaagaagaacgcaaaagaagagagcagcagaaacatgccaaagaacaggaggagctgaatgatgctgtgggattttctagagtcattcacgccattgctaattcgggaaaacttgttattggacacaatatgctcttggacgtcatgcacacagttcatcagttctactgccctctgcctgcggacttaagtgagtttaaagagatgacaacatgtgttttccccagactcttggatactaaattgatggccagcacacaaccttttaaggatatcattaacaacacatcccttgcggaattggaaaagcggttaaaagagacacctttcaaccctcctaaagttgaaagtgccgaaggttttccaagttatgacacagcctctgaacaactccacgaggcaggctacgatgcctacatcacagggctgtgcttcatctccatggccaattacctaggttcttttctcagccctccaaaaattcatgtgtctgccagatcaaaactcattgaacctttttttaacaagttatttcttatgagggtcatggatatcccctatctaaacttggaaggaccagacttgcagcctaaacgtgatcatgttctccatgtgacattccccaaagaatggaaaaccagcgacctttaccagcttttcagtgcctttggtaacattcagatatcctggattgatgacacatcagcatttgtttcccttagccagcccgagcaagtaaagattgctgtcaataccagcaaatatgcagaaagctatcggatccaaacctatgctgaatatatggggagaaaacaggaagagaagcagatcaaaagaaagtggactgaagatagctggaaggaggctgacagcaaacggttaaacccccagtgcataccctacaccctgcagaatcactattaccgcaacaatagttttacagctcccagcacagtaggaaagagaaatttgagtcctagtcaagaggaagctggcctggaggacggagtgtcaggggagatttccgacactgagcttgagcagaccgattcctgtgcagagcccctctcagagggaaggaaaaaggccaagaaattaaaaagaatgaagaaggagctttctccagcaggaagcatctcgaagaacagccctgccacactctttgaagttcctgacacatggtaaccaagacctgagggcagcaaaccgctggtgctgtcgctgtgagcaagag

SEQ ID NO: 22909 - DNA, 1748 bp, Homo sapiens
gaaagcgggcttcccgccccgcccagaccgccgaggctgccgccggagtcgccaccgccgcgccctcgcccacccgcccgcccgccgctcccggccccgctcgccccctccgccgccgccgcccgcccctgcgactacgctgcggcctcccgcccgctcccgctcgctcccgcggccctcgctcgcctcgcgccggcagttttgggcctacacctcccctccccccgccagccgccaaagacttgaccacgtaacgagcccaactcccccgaacgccgcccgccgctcgccatggatgccggtgtgactgaaagtggactaaatgtgactctcaccattcggcttcttatgcacggaaaggaagtaggaagcatcattgggaagaaaggggagtcggttaagaggatccgcgaggagagtggcgcgcggatcaacatctcggaggggaattgtccggagagaatcatcactctgaccggccccaccaatgccatctttaaggctttcgctatgatcatcgacaagctggaggaagatatcaacagctccatgaccaacagtaccgcggccagcaggcccccggtcaccctgaggctggtggtgccggccacccagtgcggctccctgattgggaaaggcgggtgtaagatcaaagagatccgcgagagtacgggggcgcaggtccaggtggcgggggatatgctgcccaactccaccgagcgggccatcaccatcgctggcgtgccgcagtctgtcaccgagtgtgtcaagcagatttgcctggtcatgctggagacgctctcccagtctccgcaagggagagtcatgaccattccgtaccagcccatgccggccagctccccagtcatctgcgcgggcggccaagatcggtgcagcgacgctgcgggctacccccatgccacccatgacctggagggaccacctctagatgcctactcgattcaaggacaacacaccatttctccgctcgatctggccaagctgaaccaggtggcaagacaacagtctcactttgccatgatgcacggcgggaccggattcgccggaattgactccagctctccagaggtgaaaggctattgggcaagtttggatgcatctactcaaaccacccatgaactcaccattccaaataacttaattggctgcataatcgggcgccaaggcgccaacattaatgagatccgccagatgtccggggcccagatcaaaattgccaacccagtggaaggctcctctggtaggcaggttactatcactggctctgctgccagtattagtctggcccagtatctaatcaatgccaggctttcctctgagaagggcatggggtgcagctagaacagtgtaggttccctcaataacccctttctgctgttctcccatgatccaactgtgtaatttctggtcagtgattccaggttttaaataatttgtaagtgttcagtttctacacaactttatcatccgctaagaatttaaaaatcacattctctgttcagctgttaatgctgggatccatatttagttttataagcttttccctgtttttagttttgttttgggttttttggctcatgaattttatttctgtttgtcgataagaaatgtaagagtggaatgttaataaatttcagtttagttctgtaatgtcaagaatttaagaattaaaaaacggattggttaaaaaatgcttcatatttgaaaaagctgggaattgctgtctt

SEQ ID NO: 22910 - DNA, 3026 bp, Homo sapiens
cccagaccagcagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtgcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggcgcatatatatatatatatgtatatatatataatttatataaatatttctctatgt

SEQ ID NO: 22911 - DNA, 1614 bp, Homo sapiens
cagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctc

SEQ ID NO: 22912 - DNA, 3077 bp, Homo sapiens
cccagaccagcagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtgattcatgtgggttttattcctcttgtcttgctgttatttttgtaccttttatccctcaaaggacccttcttgggttttgaatggaagcctttattccggttaagatgttttcttctattttaccacttccatctttttttgtggccctcgatcctatttttccctgactccatgcttggttggcccttataaaacttgtgcccaaaagattgaggattagactttccgaggacttacctgtcctaggggagtaggcaagcacttccactagggagggggtgggggaaaggaatgacacatgacatacatggcatacacattaagcagttgatcatatgtctgactgggttccagtttcttgggaatgttggtccccttgttcaggcttgcatattttaaactaaaaatttcagtctattgtttttagtaacttcatttatagtcctccataacaagttagaaggatgtatctgctaccatttattcctataattttagaaagttggggcttgacattatactcatttagtgagagtagatgcaaaaaagtggaggggcaggagaacttctccagacacctcagataaagtccggagcccaaggctttatcttaaccatgtatggtaccccattcattcatcaagaaaaccctcaacagctgggcctgcatggagtgttatatttcaaggtttttcacaggggttacagtaggacagtccccaccccaatcaggcaccaggataaaagcagggacttaaacagcaccccggttcttcagcctgagccatcacatgctatcagtctcctaacctccccctgggccttaagacagggcttgggcagagaagataaatggtgggacaaaaaaatgagttacattgccacctgagaaacctcagaggggaggacccagccttagcctccctcctcccaagtgcaaaatgtgtaaacagagtaaacggaacagaaaagtgcagtctaagtggttttctctcctgcccctcccaccgcccctccccccaccccctattatttggggataaagaatataaagacaaccctggcttttctattgccttgttgcttgctgaatataaggaatggggtggggcaggaaggggcttgcccttagccacagctctacggctgtgcctcattcatttccacagctgccagtgtccctagagtttatcaggtgaattggtcaggggatcagtctccctcgagcctgacttacggctgggacagccccatctttctgttgattatgtggcgcatatatatatatatatgtatatatatataatttatataaatatttctctatgt

SEQ ID NO: 22913 - DNA, 1571 bp, Homo sapiens
aagagccgagactgcgaaggagaacgcagcaagcccaggcggcggtggaaaggctggaggacacacctaaacatgtggaatcccaatgccgggcagccagggccaaatccatatccccccaatattgggtgccctggaggttccaatcctgcccacccaccacctattaatccaccctttcccccaggcccctgtcctcctcccccaggagctccccatggcaatccagctttccccccaggtgggccccctcatcctgtgccacagccagggtatccaggatgccaaccgttgggtccctaccctcctccatacccaccgcctgcccctggaatccctcctgtgaatcccttggctcctggcatggttggaccagcagtgatagtagacaagaagatgcagaagaaaatgaagaaagctcataaaaagatgcacaagcaccaaaagcaccacaagtaccacaagcatggcaagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggtatggatacctcagtgtttatttctgtaaggtgtagtgcaagagagaggccagtcccaaggtctcagcttgacatctgtttaaaacaaacttcgttatccagcatcctgctggtttaaacttgcctgtctactatggctaagcccaaggaggtaatgtgtttgttaacgtggttttcatttggggtcagttattctaaaagaaaaaaaaagccctggaaggtttgggggtgagg

SEQ ID NO: 22914 - DNA, 1457 bp, Homo sapiens
cttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggtttttttttttt

SEQ ID NO: 22915 - DNA, 1730 bp, Homo sapiens
cccagaccagcagaggcagcagccggagcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgcc

SEQ ID NO: 22916 - DNA, 1814 bp, Homo sapiens
gcagccgcagcctgcgccctctcccgcccgcccgccctccgcccgcccgcccgccctccgccgccctccacccgccccggggtctctttcccccttcctcctcctcctcctccacccccccttcctcctccgcccgcccgcggggcccccctcgccttcccgcccgcccctattgttccgcccccggcctcccgcccttccccttcccgcccgctccccttttcccctcagtcgcctcgcgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagactctctcccagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattgggcaggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctttctctgttcagctgttgatgctgagatccatatttagttttataagcttctccctggttttttttttttggctcatgaatttttctgtttgtcatggaaatgtaagagtggaatattaatacatttcagtttagttctgtaatgtcaggaatttttcaaaaaaattaaaagatggactggagctttttctttgtgaatagaaactggatgccacagtg

SEQ ID NO: 22917 - DNA, 1342 bp, Homo sapiens
cgcctgcagtttttggctttcacccccaaccagtgaccaaagacttgaccactcaaagtccagctccccagaacactgctcgacatggacaccggtgtgattgaaggtggattaaatgtcactctcaccatccggctacttatgcatggaaaggaagttggcagtatcatcggaaagaaaggagaatcagttaagaagatgcgcgaggagagtggtgcacgtatcaacatctcagaagggaattgtcctgagagaattatcactttggctggacccactaatgccatcttcaaagcctttgctatgatcattgacaaactggaagaggacataagcagctctatgaccaatagcacagctgccagtagacccccggtcaccctgaggctggtggtccctgctagtcagtgtggctctctcattggaaaaggtggatgcaagatcaaggaaatacgagagagtacaggggctcaggtccaggtggcaggggatatgctacccaactcaactgagcgggccatcactattgctggcattccacaatccatcattgagtgtgtcaaacagatctgcgtggtcatgttggagtcccccccgaagggcgtgaccatcccgtaccggcccaagccgtccagctctccggtcatctttgcaggtggtcaggacaggtacagcacaggcagcgacagtgcgagctttccccacaccaccccgtccatgtgcctcaaccctgacctggagggaccacctctagaggcctataccattcaaggacagtatgccattccacagccagatttgaccaagctgcaccagttggcaatgcaacagtctcattttcccatgacgcatggcaacaccggattcagtggcattgaatccagctctccagaggtgaaaggctattggggtttggatgcatctgctcagactacttctcatgaactcaccattccaaacgatttgattggctgcataatcgggcgtcaaggcgccaaaatcaatgagatccgtcagatgtctggggcgcagatcaaaattgcgaacccagtggaaggatctactgataggcaggttaccatcactggatctgctgccagcattagcctggctcaatatctaatcaatgtcaggctttcctcggagacgggtggcatggggagcagctagaacaatgcagattcatccataatccctttctgctgttcaccaccacccatgatccatctgtgtagtttctgaacagtcagcgattccaggttttaaatagtttgtaaattttcagtttctacacactttatcatccactcgtgattttttaattaaagcgttttaattcctt

SEQ ID NO: 22918 - DNA, 1772 bp, Homo sapiens
ctctctccaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggtaagaggagccgccattgtctctaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcct

SEQ ID NO: 22919 - DNA, 1717 bp, Homo sapiens
cctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 22920 - DNA, 1911 bp, Homo sapiens
gtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 22921 - DNA, 1986 bp, Homo sapiens
gtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 22922 - DNA, 2168 bp, Homo sapiens
gtacacgccatggtgtgggagcagcctgaccatcgggactcaggagcttacagaattttctggggtttcgatactctagaggtttcccctggttacttggcgaatattctatgaaaatgaagagaatgaagtgaagtcagagtcatttactcagaatgcaccctactgtaaatggagaggatgctacttggagtgtgtggtctgtataaatggagaggatgcatatgaagttacaaagggtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 22923 - DNA, 2202 bp, Homo sapiens
tcgggctggagcgcctgaagccgcgaccgccgcctcagccgcctcagccgcggtcgccgccgcttcggctgacttaggctccgccgccgcctcctcacccgcctcgccccgaccccgcccgggcctcccggcctctccccgccggcccgcgggctcgccgtccggcgcagggcaggactgtctacaagagagaagctccccacgtggttccgtgtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctca

SEQ ID NO: 22924 - DNA, 1988 bp, Homo sapiens
gtcggtaggctccacgacaaaagtcaacccttctgtaaatcacctgctgtggttatgatgctctgagttcaatacgtctgaacctttgctgtctatggatctgctctaaaccttatagcctgcttatgggggaaggtgacgccttctgggccccatctgtccttcctcacagcaccctcagcaccttaagccaccaccctcagccacaatttggcagaaggatggagtccaaggtctcagaaggtggcctgaatgtgaccctcaccatccgcctgctgatgcatggaaaggaagttggaagcatcatcgggaagaaaggagaaactgtgaagaagatgcgtgaggagagtggtgcaaggatcaacatctcagagggaaactgcccagagaggattgtgaccatcacaggccccacagacgccatcttcaaggcctttgccatgatcgcatacaagtttgaggaggatatcatcaactccatgagcaacagccctgccaccagcaagcccccagtgacgctgaggctggtggtgcctgccagccagtgtgggtccctgatcggcaaaggaggctccaagatcaaggagatcagggagtccacaggtgcccaggtgcaggtggctggggacatgctgcccaactccacggagcgagcggtgaccatctcggggaccccagatgccatcatccagtgcgtcaagcagatctgtgtggtcatgctggagtccccaccgaaaggtgccaccattccctaccgcccaaagcccgcctccacccctgtcatttttgcaggtggtcaggcctacacaatccagggacagtatgccatccctcacccggatcagttgaccaagctccaccagttggccatgcagcaaaccccctttcctcccctcggacagaccaaccccgctttccccggagaaaagctgcctttacactcctccgaagaagctcaaaatctgatgggccagtcatcaggtctggacgccagcccaccggccagcactcatgagctcaccattcccaatgatctaataggctgcataattggacgccaagggaccaaaatcaatgaaattcgacagatgtctggagctcagatcaaaatcgccaacgccacggaagggtcctcagagcgtcagatcaccatcacggggaccccggccaacatcagccttgcccagtatctcatcaacgccaggctgacgtccgaggtcaccgggatgggcacgctgtaatcctacccagcacccttcccccgcgtcacccacctgccagagcctaaggcccccggctctcgcactctgtacagcccaccttccctgcctcacagataccaatagagaggttttcttaattaacaaaaggacgtatgccatggagaaacacacccgcgcacacagctgctctctacagaggctgcaggctccgccgagtcccccctcagtgttattttatttatgacttacgctcccgtctgcccatgcaccggcatgcagtggtaattattttagaaatattgttccttggtgtcagcgtagctgtctgtcttaggagctgggtcggcgttccgacagcacttcctgtccgcccttctcctctgccatccagaaccgtccagaactgttgcctgagacccctcctctctcacacagccctgccatgctgactcggtttcccctcagagccattgttgtctgggctcgagtttctgccccaggttgtgtgctggaatcggggggtggctctcctgccacccatggggagcgccaggagaggagggtcatggaggatgttggggctctgaccccaggagtggggtggagggcggagcctgctgggggccctgccttcacagagatgccgcgtgctgggaaggctcttggggtcccctgagcgtcttccagggtggctggagagcacagacgcgccagggagccccctctgtgctcctcagagttcaataaatgtcgtggcccctcctc

SEQ ID NO: 22925 - DNA, 243 bp, Homo sapiens
ctctacttcagcccttcatttcctggtagccactgagctgccccatggacactgggcagatggccagtgttagctgggaaggacagcagcagccgcagaggtggcagcaaggccagggcactttgcagacggcatggacgggtgacgccttctgggccccatctgtccttcctcacagcaccctcagcaccttaagccaccaccctcagccacaatttggcagaaggatggagtccaaggtct

SEQ ID NO: 22926 - DNA, 5145 bp, Homo sapiens
ccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaagagcgggcagctaaagttgctgagcagcaggagagagagcgagcagcacagcaacagcagccgagtgcttctccccgagcaggcacccctgtgggggctctcatgggggtggtgccaccaccaacaccaatggggatgctcaatcagcagttgacacctgttgcaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggt

SEQ ID NO: 22927 - DNA, 4825 bp, Homo sapiens
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggt

SEQ ID NO: 22928 - DNA, 7523 bp, Homo sapiens
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgagtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcatatgtttccttcgtttaaaaccagtttcataattggttgtatatgtagacttggagttttatctttttacttgttgccatggaactgaaaccattagaggtttttgtcttggcttggggtttttgttttcttggttttgggtttttttatatatatatataaaagaacaaaatgaaaaaaaacacacacacacaagagtttacagattagtttaaattgataatgaaatgtgaagtttgtcctagtttacatcttagagaggggagtatacttgtgtttgtttcatgtgcctgaatatcttaagccactttctgcaaaagctgtttcttacagatgaagtgctttctttgaaaggtggttatttaggttttagatgtttaatagacacagcacatttgctctattaactcagaggctcactacagaaatatgtaatcagtgctgtgcatctgtctgcagctaatgtacctcctggacaccaggaggggaaaaagcactttttcaattgtgctgagttagacatctgtgagttagactatggtgtcagtgatttttgcagaacacgtgcacaaccctgaggtatgtttaatctaggcaggtacgtttaaggatattttgatctatttataatgaattcacaatttatgcctataaatttcagatgatttaaaattttaaacctgttacattgaaaaacattgaagttcgtcttgaagaaagcattaaggtatgcatggaggtgatttatttttaaacataacacctaacctaacatgggtaagagagtatggaactagatatgagctgtataagaagcataattgtgaacaagtagattgattgccttcatatacaagtatgttttagtattccttatttccttattatcagatgtattttttcttttaagtttcaatgttgttataattctcaaccagaaatttaatactttctaaaatattttttaaatttagcttgtgcttttgaattacaggagaagggaatcataatttaataaaacgcttactagaaagaccattacagatcccaaacacttgggtttggtgaccctgtctttcttatatgaccctacaataaacatttgaaggcagcataggatggcagacagtaggaacattgtttcacttggcggcatgtttttgaaacctgctttatagtaactgggtgattgccattgtggtagagcttccactgctgtttataatctgagagagttaatctcagaggatgcttttttccttttaatctgctatgaatcagtacccagatgtttaattactgtacttattaaatcatgagggcaaaagagtgtagaatggaaaaaagtctcttgtatctagatactttaaatatgggaggccctttaacttaattgcctttagtcaaccactggatttgaatttgcatcaagtattttaaataatattgaatttaaaaaaatgtattgcagtagtgtgtcagtaccttattgttaaagtgagtcagataaatcttcaattcctggctatttgggcaattgaatcatcatggactgtataatgcaatcagattattttgtttctagacatccttgaattacaccaaagaacatgaaatttagttgtggttaaattatttatttatttcatgcattcattttatttcccttaaggtctggatgagacttctttggggagcctctaaaaaaatttttcactgggggccacgtgggtcattagaagccagagctctcctccaggctccttcccagtgcctagaggtgctataggaaacatagatccagccaggggcttccctaaagcagtgcagcaccggcccagggcatcactagacaggccctaattaagttttttttaaaaagcctgtgtatttattttagaatcatgtttttctgtatattaacttgggggatatcgttaatatttaggatataagatttgaggtcagccatcttcaaaaaagaaaaaaaaattgactcaagaaagtacaagtaaactatacacctttttttcataagttttaggaactgtagtaatgtggcttagaaagtataatggcctaaatgttttcaaaatgtaagttcctgtggagaagaattgtttatattgcaaacggggggactgaggggaacctgtaggtttaaaacagtatgtttgtcagccaactgatttaaaaggcctttaactgttttggttgttgttttttttttaagccactctccccttcctatgaggaagaattgagaggggcacctatttctgtaaaatccccaaattggtgttgatgattttgagcttgaatgttttcatacctgattaaaacttggtttattctaatttctgtatcatatcatctgaggtttacgtggtaactagtcttataacatgtatgtatcttttttttgttgttcatctaaagctttttaatccaaataaatacagagtttgcaaagtgatttggattaaccagg

SEQ ID NO: 22929 - DNA, 5071 bp, Homo sapiens
aggagcaatagcagcagccgtggcggccacggggcggggcgcggcggtcggtgaccgcggccggggctgcaggcggcggagcggctggaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctgaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactgggggtggggggaaggaacaaaggaggataatttttattgcattttactgtacatcacaaggccatttttatatacggacacttttaataagctatttcaatttgtttgttatattaagttgactttatcaaatacacaaagatttttttgcata

SEQ ID NO: 22930 - DNA, 4980 bp, Homo sapiens
tccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaagaccattgcccagaggatacagaatggaagctacaaaagtattcatgcaatggccaaagatatagatctcctcgcaaaaaatgccaaaacttataatgagcctggctctcaagtattcaaggatgcaaattcaattaaaaaaatattttatatgaaaaaggctgaaattgaacatcatgaaatggctaagtcaagtcttcgaatgaggactccatccaacttggctgcagccagactgacaggtccttcacacagtaaaggcagccttggtgaagagagaaatcccactagcaagtattaccgtaataaaagagcagtacaaggaggtcgtttatcagcaattacaatggcacttcaatatggctcagaaagtgaagaagatgctgctttagctgctgcacgctatgaagagggagagtcagaagcagaaagcatcacttcctttatggatgtttcaaatcctttttatcagctttatgacacagttaggagttgtcggaataaccaagggcagctaatagctgaacctttttaccatttgccttcaaagaaaaaataccctgattattaccagcaaattaaaatgcccatatcactacaacagatccgaacaaaactgaagaatcaagaatatgaaactttagatcatttggagtgtgatctgaatttaatgtttgaaaatgccaaacgctataatgtgcccaattcagccatctacaagcgagttctaaaattgcagcaagttatgcaggcaaagaagaaagagcttgccaggagagacgatatcgaggacggagacagcatgatctcttcagccacctctgatactggtagtgccaaaagaaaaagtaaaaagaacataagaaagcagcgaatgaaaatcttattcaatgttgttcttgaagctcgagagccaggttcaggcagaagactttgtgacctatttatggttaaaccatccaaaaaggactatcctgattattataaaatcatcttggagccaatggacttgaaaataattgagcataacatccgcaatgacaaatatgctggtgaagagggaatgatagaagacatgaagctgatgttccggaatgccaggcactataatgaggagggctcccaggtttataatgatgcacatatcctggagaagttactcaaggagaaaaggaaagagctgggcccactgcctgatgatgatgacatggcttctcccaaactcaagctgagtaggaagagtggcatttctcctaaaaaatcaaaatacatgactccaatgcagcagaaactaaatgaggtctatgaagctgtaaagaactatactgataagaggggtcgccgcctcagtgccatatttctgaggcttccctctagatctgagttgcctgactactatctgactattaaaaagcccatggacatggaaaaaattcgaagtcacatgatggccaacaagtaccaagatattgactctatggttgaggactttgtcatgatgtttaataatgcctgtacatacaatgagccggagtctttgatctacaaagatgctcttgttctacacaaagtcctgcttgaaacacgcagagacctggagggagatgaggactctcatgtcccaaatgtgactttgctgattcaagagcttatccacaatctttttgtgtcagtcatgagtcatcaggatgatgagggaagatgctacagcgattctttagcagaaattcctgctgtggatcccaactttcctaacaaaccaccccttacatttgacataattaggaagaatgttgaaaataatcgctaccgtcggcttgatttatttcaagagcatatgtttgaagtattggaacgagcaagaaggatgaatcggacagattcagaaatatatgaagatgcagtagaacttcagcagttttttattaaaattcgtgatgaactctgcaaaaatggagagattcttctttcaccggcactcagctataccacaaaacatttgcataatgatgtggagaaagagagaaaggaaaaattgccaaaagaaatagaggaagataaactaaaacgagaagaagaaaaaagagaagctgaaaagagtgaagattcctctggtgctgcaggcctctcaggcttacatcgcacatacagccaggactgtagctttaaaaacagcatgtaccatgttggagattacgtctatgtggaacctgcagaggccaacctacaaccacatatcgtctgtattgaaagactgtgggaggattcagctggtgaaaaatggttgtatggctgttggttttaccgaccaaatgaaacattccacctggctacacgaaaatttctagaaaaagaagtttttaagagtgactattacaacaaagttccagttagtaaaattctaggcaagtgtgtggtcatgtttgtcaaggaatactttaagttatgcccagaaaacttccgagatgaggatgtttttgtctgtgaatcacggtattctgccaaaaccaaatcttttaagaaaattaaactgtggaccatgcccatcagctcagtcaggtttgtccctcgggatgtgcctctgcctgtggttcgcgtggcctctgtatttgcaaatgcagataaaggtgatgatgagaagaatacagacaactcagaggacagtcgagctgaagacaattttaacttggaaaaggaaaaagaagatgtccctgtggaaatgtccaatggtgaaccaggttgccactactttgagcagctccattacaatgacatgtggctgaaggttggcgactgtgtcttcatcaagtcccatggcctggtgcgtcctcgtgtgggcagaattgaaaaagtatgggttcgagatggagctgcatatttttatggccccatcttcattcacccagaagaaacagagcatgagcccacaaaaatgttctacaaaaaagaagtatttctgagtaatctggaagaaacctgccccatgacatgtattctcggaaagtgtgctgtgttgtcattcaaggacttcctctcctgcaggccaactgaaataccagaaaatgacattctgctttgtgagagccgctacaatgagagcgacaagcagatgaagaaattcaaaggattgaagaggttttcactctctgctaaagtggtagatgatgaaatttactacttcagaaaaccaattgttcctcagaaggagccatcacctttgctggaaaagaagatccagttgctagaagctaaatttgccgagttagaaggtggagatgatgatattgaagagatgggagaagaagatagtgaggtcattgaacctccttctctacctcagcttcagacccccctggccagtgagctggacctcatgccctacacacccccacagtctaccccaaagtctgccaaaggcagtgcaaagaaggaaggctccaaacggaaaatcaacatgagtggctacatcctgttcagcagtgagatgagggctgtgattaaggcccaacacccagactactctttcggggagctcagccgcctggtggggacagaatggagaaatcttgagacagccaagaaagcagaatatgaaggcatgatgggtggctatccgccaggccttccacctttgcagggcccagttgatggccttgttagcatgggcagcatgcagccacttcaccctggggggcctccaccccaccatcttccgccaggtgtgcctggcctcccgggcatcccaccaccgggtgtgatgaaccaaggagtggcccctatggtagggactccagcaccaggtggaagtccatatggacaacaggtgggagttttggggcctccagggcagcaggcaccacctccatatcccggcccacatccagctggaccccctgtcatacagcagccaacaacacccatgtttgtagctcccccaccaaagacccagcggcttcttcactcagaggcctacctgaaatacattgaaggactcagtgcggagtccaacagcattagcaagtgggatcagacactggcagctcgaagacgcgacgtccatttgtcgaaagaacaggagagccgcctaccctctcactggctgaaaagcaaaggggcccacaccaccatggcagatgccctctggcgccttcgagatttgatgctccgggacaccctcaacattcgccaagcatacaacctagaaaatgtttaatcacatcattacgtttcttttatatagaagcataaagagttgtggatcagtagccattttagttactggggg

SEQ ID NO: 22931 - DNA, 783 bp, Homo sapiens
gactggttttgcggcggcaccgggaggggtaagggaggtgagggcggcgggtgccgaagcgacggcagcggccgcggccggaggagcaatagcagcagccgtggcggccacggggcggggcgcggcggtcggtgaccgcggccggggctgcaggcggcggagcggctggcttgccaacacttggtgtcacatgtgagcctcccacatgtattcactctccattccagctctgtgattgaactctgctcttattgactagggggcagttgggcaggcatgcctcattcctggaattgacagtcattcctaataagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttc

SEQ ID NO: 22932 - DNA, 457 bp, Homo sapiens
ggcggtcggtgaccgcggccggggctgcaggcggcggagcggctgggtcgcccatatttgattttgagctccaaaatggaagattggaaaatatgttttgaagagcttgccaacacttggtgtcacatgtgagcctcccacatgtattcactctccattccagctctgtgattgaactctgctcttattgactagggggcagttgggcaggcatgcctcattcctggaattgacagtcattcctaatttttgaatatactaacactgaatcagcacttctaaagcccttccttctcccactggcttcacttggctttcagacataatgaggagactggcttttcgaggcgctggttgtgctctgaagaagttggattccatgggttccaagagaagaagagctacctccccttccagcagtgtcagcggggactttgatgatgggcaccattctgtg

SEQ ID NO: 22933 - DNA, 809 bp, Homo sapiens
gcggccgcggccggaggagcaatagcagcagccgtggcggccacggggcggggcgcggcggtcggtgaccgcggccggggctgcaggcggcggagcggctggaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttctttttaacaatgcaaagtcctattataagccagattctcctgaatataaagccgcttgcaaactctgggatttgtaccttcgaacaagaaatgagtttgttcagaaaggagaagcagatgacgaagatgatgatgaagatgggcaagacaatcagggcacagtgactgaaggatcttctccagcttacttgaaggagatcctggagcagcttcttgaagccatagttgtagctacaaatccatcaggacgtctcattagcgaactttttcagaaactgccttctaaagtgcaatatccagattattatgcaataattaaggagcctatagatctcaa

SEQ ID NO: 22934 - DNA, 547 bp, Homo sapiens
tgggcccagtagccttgtcgcacctgccggcagggacaaaggcgcactacgggtcggaaactccccgcgctcctctttcccgctcgtcgcggggcagcttcaaagctgtcaacgtttccctcagtccccaataccagtgacagcttgccaacacttggtgtcacatgtgagcctcccacatgtattcactctccattccagctctgtgattgaactctgctcttattgactagggggcagttgggcaggcatgcctcattcctggaattgacagtcattcctaatttttgaatatactaacactgaatcagcacttctaaagcccttccttctcccactggcttcacttggctttcagacataatgaggagactggcttttcgaggcgctggttgtgctctgaagaagttggattccatgggttccaagagaagaagagctacctccccttccagcagtgtcagcggggactttgatgatgggcaccattctgtgtcaacaccaggcccaagcaggaaaaggaggagactttccaatcttccaactg

SEQ ID NO: 22935 - DNA, 517 bp, Homo sapiens
cggatgggcccagtagccttgtcgcacctgccggcagggacaaaggcgcactacgggtcggaaactccccgcgctcctctttcccgctcgtcgcggggcagcttcaaagctgtcaacgtttccctcagtccccaataccagtgacagaagaagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtggtttctcagcccattgacttgatgaaaatccaacagaaactaaaaatggaagagtatgatgatgttaatttgctgactgctgacttccagcttc

SEQ ID NO: 22936 - DNA, 517 bp, Homo sapiens
gcggccgcggccggaggagcaatagcagcagccgtggcggccacggggcggggcgcggcggtcggtgaccgcggccggggctgcaggcggcggagcggctggcttgccaacacttggtgtcacatgtgagcctcccacatgtattcactctccattccagctctgtgattgaactctgctcttattgactagggggcagttgggcaggcatgcctcattcctggaattgacagtcattcctaataagttggattccatgggttccaagagaagaagagctacctccccttccagcagtgtcagcggggactttgatgatgggcaccattctgtgtcaacaccaggcccaagcaggaaaaggaggagactttccaatcttccaactgtagatcctattgccgtgtgccatgaactctataataccatccgagactataaggatgaacagggcagacttctctgtgagctcttcattagggcaccaaagcgaagaaatcaaccagactattatgaagtg

SEQ ID NO: 22937 - DNA, 476 bp, Homo sapiens
aggtgagggcggcgggtgccgaagcgacggcagcggccgcggccggaggagcaatagcagcagccgtggcggccacggggcggggcgcggcggtcggtgaccgcggccggggctgcaggcggcggagcggctgggtcgcccatatttgattttgagctccaaaatggaagattggaaaatatgttttgaagagcttgccaacacttggtgtcacatgtgagcctcccacatgtattcactctccattccagctctgtgattgaactctgctcttattgactagggggcagttgggcaggcatgcctcattcctggaattgacagtcattcctaataagttggattccatgggttccaagagaagaagagctacctccccttccagcagtgtcagcggggactttgatgatgggcaccattctgtgtcaacaccaggcccaagcaggaaaaggaggagactttccaatcttccaact

SEQ ID NO: 22938 - DNA, 1950 bp, Homo sapiens
gtctctcccgaccatggagggggtcgcggtggtgacggcgggcagcgtaggcgctgccaaaaccgagggagctgcagccttgccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataagtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaaccta

SEQ ID NO: 22939 - DNA, 2230 bp, Homo sapiens
ggcgtccgaggccggccgaactcccgcgctctcccgccgcctcgcctcgcctggtgtctctcccgaccatggagggggtcgcggtggtgacggcgggcagcgtaggcgctgccaaaaccgagggagctgcagccttgccgcctccgcctcctgtctccccgcccgccctcacccctgcacccgcagcgggtgaggagggaccggcgcctctgtctgagacgggggctcccggctgctccggctcccggccccctgagctggagccggagcgcagcctgggccgcttcagaggccgcttcgaggacgaggacgaggagttggaagaagaagaggagctggaggaggaagaagaggaggaggaggaggacatgagtcacttctcgttgaggctggagggaggccggcaggactcggaggacgaggaggagcgcctgattaatctctctgagctgaccccatacatcttgtgttccatttgcaaaggttacttaatagatgcaactaccatcacagaatgtcttcataccttttgtaaaagctgcatcgtaagacatttttactacagcaacagatgtccaaaatgcaatatagtagtacatcagacacaacctctttataacataaggttggaccgacagttacaagacatagtgtacaaattagtgatcaatctagaggaaagagaaaaaaagcaaatgcatgatttctataaagaaagaggtctagaagtacctaaacctgctgttccacagccagtcccttcaagcaaaggaagatctaaaaaagtcctagaatcagtgtttcgtattccacctgaacttgatatgtctttattactggagttcattggtgctaatgaaggcacgggacattttaagccattggaaaagaagtttgttcgagtttcaggagaagcaactattggacatgtagaaaaattcctcagaagaaaaatgggtcttgatccagcttgtcaggtagatataatctgtggtgatcacctgttggagcagtatcaaactctaagggaaatccgacgtgcaataggtgatgcagcaatgcaggatggtctgcttgtccttcattatggtcttgtggtttctcctctgaagataacttgaagattctaggcacattatgaggagggaaacaaaggaggcttctgcaggactgcatctcaccaaagatttccatgaaatgtaattgctaccactttgctgttcaagacataacttacctatttttagcaccaagaattatagcgtttataagtacaacttggaacgatggaatgcatctgttactagagactgtatataaaaagcagccaaagctcaggggaaatttttcaaaaattgaattttaaaatttcttatgattttaaataccttgacattgattttgcttcccatctttgaagtaattggttagttttctttgttcagccatttcaagttggtggttgggatatctgctctctgggatggcatcagttgggcagtcatctttttggaagagaagtgtgcttttgagtggaagattcaaagccagtctttgttaaactgcagggtgtactctcaaagaccaaaactattggccacttttgtatgttgccagcatattttgaacttgtacctttttttatactagcaacactacaaaggagaagttactcatttcaaaatggatgaattgttattatgtgtgaagagactctgagtttatgatctgtgccataaaatttcagtgtaataagacttcttcaatacatcttccaataaggggtgcttctttgtgacagtatttttatttctgacattcattttatttgggtacatagtgtggttgttgataccttgcaatagtattgcttctgaaagtaataaaaaattttaggagaatttgagaagtttacagaattacttattcattgttttcttagtaagtcagtttaatgtttatttttctcattatttcatcactgcaataaagaataagggtgtttgagctcacctccatgcaaagacttcagttttaaaacattatttgcctaaaattagcattgtgatgctttctgaaagaaatattttataaatcctgtttaacagcagaatttctgaatgtgtagagactactacaaaattggaaaaagattggcaattctttgtaaagaatttgtgaattgtgtataaatttattctaacatttaataaaaatgtattttaaccta

SEQ ID NO: 22940 - DNA, 11589 bp, Homo sapiens
acaaacgagttaggtgagttatagtctaacgtgagtgagttacctgcgtggtggctgcaggctgagctctaaccagataacatgtccacggattcttgacagagagaaataagatcacttagaaagaaaggatcatttctcccttgagtcacaaggagacagaaacagaaaaaaaagcacaaaagctatgctgctccaatcaaaactgaaaatgcttttaatgtctgagcaatcttaagagtattgatttaagtggacagaatgactgcctggctgatctctctgatgagtattgaagtactacttttggcagtacgtcacctgagtttacatattgaacctgaagaaggtagccttgcagggggaacgtggatcacagtcatttttgatggtttggagttgggtgttctttaccccaacaatggctctcaattggagatacacctggtgaacgtgaacatggtggtgcccgcactgcggagtgttccctgtgacgtctttcctgttttcttggatttgcctgtggtgacatgccggaccagatctgtgctgtctgaagcacatgagggtctgtacttcctggaagcatacttcgggggacagctggtaagcagtccaaatccaggaccacgagatagctgtactttcaagttttccaaggcgcagacacccatcgttcaccaagtttatccaccaagtggtgttccaggaaaactaatacatgtatatggctggattatcactggaagattggaaacttttgattttgatgctgagtacattgatagcccagtgatcttggaagctcaaggagacaaatgggttactccttgctctcttataaataggcagatgggaagctgttatcctattcaggaggaccatggtcttgggactctgcagtgccatgtggaaggcgactacatcggctcccagaatgttagcttctcagtatttaacaaaggaaagtcaatggtccacaagaaggcatggctgatcagtgctaaacaggatcttttcctataccagacacactcagaaatattatctgtgtttccagaaactgggagccttgggggaagaacaaacatcacaattacaggagacttttttgacaattctgcccaggttaccattgcaggcattccatgtgatattagacacgtgtctcccaggaagattgagtgcaccactcgggctccaggaaaagatgtgaggctcaccacccctcagccaggcaatcgagggcttctttttgaagttggagatgctgttgagggactggaactgactgaagccaccccagggtacaggtggcagattgtccctaatgccagttctccatttgggttttggtcacaggaaggacaacctttcagagcacggctcagtgggttctttgtggctccagagacaaataattacactttctggattcaggcagatagccaagcttccttgcatttcagttggtcagaggaaccaaggactaaggtgaaagtggcctccatcagcgtcggcactgctgactggtttgactcctgggagcagaatagggatgaagggacctggcagcagaagactcccaagttggagctgttgggtggagccatgtactacctggaagcagagcatcatgggatagccccaagcagggggatgaggattggtgtccagattcacaacacctggctgaatcctgatgtggtcaccacttacctacgggagaagcaccagatccgagtccgagcccagaggcttccagaagtacaggtgctgaatgtatcaggcagaggaaacttcttccttacttgggacaatgtctctagtcagccaatccctgcaaatgccacagcccatctgattcaaacaaccattgaggagttacttgcagtaaaatgcaaactggaacccctttggtctaacatccttctccggcttggatttgaacgaggcccagaagtttccaactctgatggggacctcaccagtgggacggagcccttctgtggcaggttcagcctccgtcagcctcgacaccttgtccttactcccccggctgcccagaagggctatcggctagatcagtatacacacctgtgtcttgcatacaaaggccacatgaacaagatcctgaagatgattgtgtccttcacaatcggctttcaaaacatggtaaagaataccacctgtgactggagtctcacgaggaccagccccgagagctggcagttcgattgcactgacctctgggagacttgtgtgcgttgcttcggggatctccagccccctccggcaaactccccagtgctggttcatcagatcaaccttctccctctggcccaggagacgggcctgttctatgtggatgaaattattattgcagacacaaacgtaacagtttctcaagctgattctggaacggctcgcccagggggcaatctggtggaatcagtctctgtggtgggatcccctccggtctacagtgtcacctcctggctggcggggtgtggcacggagctcccgctcatcactgcacgctctgtgcccactgaaggaacagaagagggatctggactggtcctggtgacgacacagagacgacagcggacaagtccacctctaggaggacactttcgcatccagcttcctaatacagtgatttctgatgtccctgtacaaatttctgctcatcaccttcaccagctcttacagaataatgccgatgacttcacatccaggtacctcaatgccagtgacttcactgtgaaggaggatctatacacttgctacgaacacgtgtggaccttgtcctggtccactcagattggggatttgcccaattttatcagggtctctgatgaaaaccttactggagtgaatcctgctgcagccacgcgtgtggtatatgatggtggagtttttcttggacccatatttggagacatgttggctactgccaaccagcatactcaggtggttgtgcgagtgaatgatgtaccagctcattgcccaggttcctgctctttccagtacctccaagggtcaactccctgtgtccattctgtgtggtactccattgatggtgacatcaacctaatgatttacattaccggaactggtttctctggtgactcccagttcttgcaggttacagtgaacaaaacgagttgcaaagttattttctcaaaccagaccaatgtagtctgtcagacagatttgctacctgttggaatgcatcggatcttgatgttggtgagaccctctggtcttgccatcagtgccactggagaagacctcttcctaaatgtgaaacctagactggatatggtggagccttccagagctgcggatattggagggctctgggccaccatccgaggctctagtttggaaggtgttagcctgatattatttggatcttactcgtgtgccatcaatgtcgctacaagcaattcaagcagaattcagtgcaaagttccacccagggggaaagatggacgcattgtgaatgtgactgtgatcagaggggactattctgcagttcttcccagagcatttacatatgtctcttccttaaatccagttattgtgactctgagcagaaacataagcaatatagcaggcggtgagaccctggtcattggagtggcgaggctgatgaactatacggatttggatgtggaagtccacgtccaggatgccttggctccggttcacacacagtcggcttggggcctggaggtggcactgcccccactgccagctggtctccacagaatttccgtctctatcaatggggtcagcattcactcacaaggggttgatctccacatccagtacctcacagaagttttcagcatcgagccttgctgtgggtccctgctgggagggaccatcctcagcatctcaggaataggcttcagcagggacccagctttggtttgggtacttgtgggcaatcggtcctgtgacattgtgaacttaacggaggcgagcatctggtgtgaaaccctgccagccccccagatacccgatgcgggcgctcccactgttccagctgccgtggaggtctgggctggcaacaggttcttcgcccgtggtccttcaccaagcttggtggggaaaggcttcaccttcatgtatgaagcggcagcaacaccagtagtcactgccatgcaaggagaaatcacaaatagcagcctgagcctgcatgtgggaggaagtaacctctccaactcagtcatccttctggggaacctgaactgtgatgttgagacacagtccttccagggcaacgtgagcctgtctggatgctccatccctcttcacagtctggaggctggcatctatcctctccaagtacgtcagaagcagatgggatttgctaatatgtctgtggtgctccagcaatttgcagtgatgcctcggataatggccatcttcccatcgcagggttcggcatgtggtgggaccatacttactgtgagggggttgcttcttaactctagaaggaggtcagttcgggttgacctctcgggtccttttacttgtgtgattttgagtttgggagaccacaccattctctgccaggttagcctggagggtgaccccttgcctggagcttccttctccctgaacgtcacagtcctggtcaatgggctaaccagcgagtgtcaggggaattgcactcttttcataagggaagaggcaagtcctgtcatggatgccttgtccacaaacaccagtgggtctctgaccactgtgctgattaggggtcagaggttagccaccacagctgatgagccgatggtatttgtggatgatcaacttccttgcaatgtaactttttttaatgcaagccacgttgtgtgccagacaagagacttggccccaggaccccactacctgtcagttttttatacaagaaatgggtatgcttgttctggtaatgtttccagacacttctacattatgccccaagtgtttcattattttcctaagaatttcagcttacatggtggaagcctcttgaccatagagggcacaggcctgagaggacagaacaccacgtcagtctatattgaccagcagacctgcctgacggtgaacatcggtgctgagctcatccggtgcattgttcccacagggaatggctctgttgccctggaaatagaggtagatggactttggtatcacataggagtcattggttataacaaggcctttaccccagaattgatctctatttctcagagcgatgacatcttaacctttgcagtggcccagatctcaggagctgcaaacattgacatttttataggaatgtcaccctgtgtgggtgtctctggtaaccacaccgttcttcagtgcgtggtcccttcccttccggccggggagtaccacgtcagaggctatgactgcatcagagggtgggcctcatctgccctggtgttcacctcaagagttattattacagcagtgacggagaacttcggctgcctgggtggaaggctggtgcatgtgtttggagcgggattttctccagggaatgtctcagctgctgtgtgtggtgctccctgccgagtcctggctaatgctacagtgtctgccttcagctgcttggttctgcccctggatgtgtccttggccttcctgtgtggcctgaagcgtgaggaggacagctgtgaggctgccagacacacctatgtgcagtgtgatttgacagttgccatggcgacagagcaactgcttgaatcgtggccttacctctacatttgcgaggaaagttcccaatgcctctttgtgccagatcattgggcagagtcaatgtttccatcattctcgggcctctttatcagccctaaattggaaagagatgaagttctcatctataatagctcctgtaacattaccatggaaactgaggcagagatggagtgtgagacgcccaatcagccaattaccgtcaagattactgagatacggaaacgctggggccagaacactcagggcaacttttctttacagttctgccggagatggtccaggactcacagctggtttcctgaaaggctgccacaagatggcgacaacgtcacagtggagaatggccaattgcttctgctggacactaacacaagcatcctcaacttactgcacattaaagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcagtaaccactgagcaggctttgaagatttcagaatagaggaggagcctgcaggaagctgaactttgaaagattaatgaggcagcaggaagcagggtgaagaatgggttggagcatggaccaaatggaaagacttgttaagacactgtttcaattgttcaaattgagaagaaattgattgaggactgggaggagattgatggcagccagaatggagaggatggtacagatcaaagaaatacaaaagagaggaaatagagtttgcttactcctgactttggggactgtggagagggtgtcaacagtgacaccattgtccgtagtcaggatatctttgggaatggaagttccagtagcagatatgggggagtaggaaagaagaggatggttgcttaagctttgcctttagtgagtttggggtacccactatatgagagaggagcaattcagatattaaattggtggtgttgaaatctttggaattagagctttggagataaattgcagctagatataaattatctggaataaagtgataggtgaaataatatggtagagaagccttattttatttctctcttctttaccaattatattgagatattattattattggcatattaatatattattattggtatattaataatataataatataggtatattatcaataatatactaatactaatataccaataatagtgggttattgttaataatattggtaaagaaagaacataaatgtaagtttattaccaagaatattggtgtggtaaagataacccatttatgctggaggttgcaattttttgaattgcaaaatcagaccttggccatgaccttaagcagtaggatataaataactcccatgtgcccagtgttccattattggaacagtgtgccattcttgtgcactgatggaggaaatagttacagatacagtgtgatttgaggaattggttcccccagagccttattgaccctcaaatacttcccttacccatgttatcatttcctttctatcctaaaattgctacctttgctgccagatcttttccttcataaagtcaatgtgacatttactcatttattaactcatttcttcaacagatacttattgggcatttactgtatgccaagtattgtaataaatgctgtatgtacaaaatgaca

SEQ ID NO: 22941 - DNA, 16282 bp, Homo sapiens
acatttggctgggacacaaacgagttaggtgagttatagtctaacgtgagtgagttacctgcgtggtggctgcaggctgagctctaaccagataacatgtccacggattcttgacagagagaaataagatcacttagaaagaaaggatcatttctcccttgagtcacaaggagacagaaacagaaaaaaaagcacaaaagctatgctgctccaatcaaaactgaaaatgcttttaatgtctgagcaatcttaagagtattgatttaagtggacagaatgactgcctggctgatctctctgatgagtattgaagtactacttttggcagtacgtcacctgagtttacatattgaacctgaagaaggtagccttgcagggggaacgtggatcacagtcatttttgatggtttggagttgggtgttctttaccccaacaatggctctcaattggagatacacctggtgaacgtgaacatggtggtgcccgcactgcggagtgttccctgtgacgtctttcctgttttcttggatttgcctgtggtgacatgccggaccagatctgtgctgtctgaagcacatgagggtctgtacttcctggaagcatacttcgggggacagctggtaagcagtccaaatccaggaccacgagatagctgtactttcaagttttccaaggcgcagacacccatcgttcaccaagtttatccaccaagtggtgttccaggaaaactaatacatgtatatggctggattatcactggaagattggaaacttttgattttgatgctgagtacattgatagcccagtgatcttggaagctcaaggagacaaatgggttactccttgctctcttataaataggcagatgggaagctgttatcctattcaggaggaccatggtcttgggactctgcagtgccatgtggaaggcgactacatcggctcccagaatgttagcttctcagtatttaacaaaggaaagtcaatggtccacaagaaggcatggctgatcagtgctaaacaggatcttttcctataccagacacactcagaaatattatctgtgtttccagaaactgggagccttgggggaagaacaaacatcacaattacaggagacttttttgacaattctgcccaggttaccattgcaggcattccatgtgatattagacacgtgtctcccaggaagattgagtgcaccactcgggctccaggaaaagatgtgaggctcaccacccctcagccaggcaatcgagggcttctttttgaagttggagatgctgttgagggactggaactgactgaagccaccccagggtacaggtggcagattgtccctaatgccagttctccatttgggttttggtcacaggaaggacaacctttcagagcacggctcagtgggttctttgtggctccagagacaaataattacactttctggattcaggcagatagccaagcttccttgcatttcagttggtcagaggaaccaaggactaaggtgaaagtggcctccatcagcgtcggcactgctgactggtttgactcctgggagcagaatagggatgaagggacctggcagcagaagactcccaagttggagctgttgggtggagccatgtactacctggaagcagagcatcatgggatagccccaagcagggggatgaggattggtgtccagattcacaacacctggctgaatcctgatgtggtcaccacttacctacgggagaagcaccagatccgagtccgagcccagaggcttccagaagtacaggtgctgaatgtatcaggcagaggaaacttcttccttacttgggacaatgtctctagtcagccaatccctgcaaatgccacagcccatctgattcaaacaaccattgaggagttacttgcagtaaaatgcaaactggaacccctttggtctaacatccttctccggcttggatttgaacgaggcccagaagtttccaactctgatggggacctcaccagtgggacggagcccttctgtggcaggttcagcctccgtcagcctcgacaccttgtccttactcccccggctgcccagaagggctatcggctagatcagtatacacacctgtgtcttgcatacaaaggccacatgaacaagatcctgaagatgattgtgtccttcacaatcggctttcaaaacatggtaaagaataccacctgtgactggagtctcacgaggaccagccccgagagctggcagttcgattgcactgacctctgggagacttgtgtgcgttgcttcggggatctccagccccctccggcaaactccccagtgctggttcatcagatcaaccttctccctctggcccaggagacgggcctgttctatgtggatgaaattattattgcagacacaaacgtaacagtttctcaagctgattctggaacggctcgcccagggggcaatctggtggaatcagtctctgtggtgggatcccctccggtctacagtgtcacctcctggctggcggggtgtggcacggagctcccgctcatcactgcacgctctgtgcccactgaaggaacagaagagggatctggactggtcctggtgacgacacagagacgacagcggacaagtccacctctaggaggacactttcgcatccagcttcctaatacagtgatttctgatgtccctgtacaaatttctgctcatcaccttcaccagctcttacagaataatgccgatgacttcacatccaggtacctcaatgccagtgacttcactgtgaaggaggatctatacacttgctacgaacacgtgtggaccttgtcctggtccactcagattggggatttgcccaattttatcagggtctctgatgaaaaccttactggagtgaatcctgctgcagccacgcgtgtggtatatgatggtggagtttttcttggacccatatttggagacatgttggctactgccaaccagcatactcaggtggttgtgcgagtgaatgatgtaccagctcattgcccaggttcctgctctttccagtacctccaagggtcaactccctgtgtccattctgtgtggtactccattgatggtgacatcaacctaatgatttacattaccggaactggtttctctggtgactcccagttcttgcaggttacagtgaacaaaacgagttgcaaagttattttctcaaaccagaccaatgtagtctgtcagacagatttgctacctgttggaatgcatcggatcttgatgttggtgagaccctctggtcttgccatcagtgccactggagaagacctcttcctaaatgtgaaacctagactggatatggtggagccttccagagctgcggatattggagggctctgggccaccatccgaggctctagtttggaaggtgttagcctgatattatttggatcttactcgtgtgccatcaatgtcgctacaagcaattcaagcagaattcagtgcaaagttccacccagggggaaagatggacgcattgtgaatgtgactgtgatcagaggggactattctgcagttcttcccagagcatttacatatgtctcttccttaaatccagttattgtgactctgagcagaaacataagcaatatagcaggcggtgagaccctggtcattggagtggcgaggctgatgaactatacggatttggatgtggaagtccacgtccaggatgccttggctccggttcacacacagtcggcttggggcctggaggtggcactgcccccactgccagctggtctccacagaatttccgtctctatcaatggggtcagcattcactcacaaggggttgatctccacatccagtacctcacagaagttttcagcatcgagccttgctgtgggtccctgctgggagggaccatcctcagcatctcaggaataggcttcagcagggacccagctttggtttgggtacttgtgggcaatcggtcctgtgacattgtgaacttaacggaggcgagcatctggtgtgaaaccctgccagccccccagatacccgatgcgggcgctcccactgttccagctgccgtggaggtctgggctggcaacaggttcttcgcccgtggtccttcaccaagcttggtggggaaaggcttcaccttcatgtatgaagcggcagcaacaccagtagtcactgccatgcaaggagaaatcacaaatagcagcctgagcctgcatgtgggaggaagtaacctctccaactcagtcatccttctggggaacctgaactgtgatgttgagacacagtccttccagggcaacgtgagcctgtctggatgctccatccctcttcacagtctggaggctggcatctatcctctccaagtacgtcagaagcagatgggatttgctaatatgtctgtggtgctccagcaatttgcagtgatgcctcggataatggccatcttcccatcgcagggttcggcatgtggtgggaccatacttactgtgagggggttgcttcttaactctagaaggaggtcagttcgggttgacctctcgggtccttttacttgtgtgattttgagtttgggagaccacaccattctctgccaggttagcctggagggtgaccccttgcctggagcttccttctccctgaacgtcacagtcctggtcaatgggctaaccagcgagtgtcaggggaattgcactcttttcataagggaagaggcaagtcctgtcatggatgccttgtccacaaacaccagtgggtctctgaccactgtgctgattaggggtcagaggttagccaccacagctgatgagccgatggtatttgtggatgatcaacttccttgcaatgtaactttttttaatgcaagccacgttgtgtgccagacaagagacttggccccaggaccccactacctgtcagttttttatacaagaaatgggtatgcttgttctggtaatgtttccagacacttctacattatgccccaagtgtttcattattttcctaagaatttcagcttacatggtggaagcctcttgaccatagagggcacaggcctgagaggacagaacaccacgtcagtctatattgaccagcagacctgcctgacggtgaacatcggtgctgagctcatccggtgcattgttcccacagggaatggctctgttgccctggaaatagaggtagatggactttggtatcacataggagtcattggttataacaaggcctttaccccagaattgatctctatttctcagagcgatgacatcttaacctttgcagtggcccagatctcaggagctgcaaacattgacatttttataggaatgtcaccctgtgtgggtgtctctggtaaccacaccgttcttcagtgcgtggtcccttcccttccggccggggagtaccacgtcagaggctatgactgcatcagagggtgggcctcatctgccctggtgttcacctcaagagttattattacagcagtgacggagaacttcggctgcctgggtggaaggctggtgcatgtgtttggagcgggattttctccagggaatgtctcagctgctgtgtgtggtgctccctgccgagtcctggctaatgctacagtgtctgccttcagctgcttggttctgcccctggatgtgtccttggccttcctgtgtggcctgaagcgtgaggaggacagctgtgaggctgccagacacacctatgtgcagtgtgatttgacagttgccatggcgacagagcaactgcttgaatcgtggccttacctctacatttgcgaggaaagttcccaatgcctctttgtgccagatcattgggcagagtcaatgtttccatcattctcgggcctctttatcagccctaaattggaaagagatgaagttctcatctataatagctcctgtaacattaccatggaaactgaggcagagatggagtgtgagacgcccaatcagccaattaccgtcaagattactgagatacggaaacgctggggccagaacactcagggcaacttttctttacagttctgccggagatggtccaggactcacagctggtttcctgaaaggctgccacaagatggcgacaacgtcacagtggagaatggccaattgcttctgctggacactaacacaagcatcctcaacttactgcacattaaagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcaggtacatttagagaagaacagaaatgtacataccaatttctgatgcaaggattcatctgcaaacagactgaccaagtggtcctaattcttgatagcgctgatgccatttgggcaattcagaagttatatccagttgtatctgtgactagtggttttgttgatgtctttagcagtgtaaatgccaatattccctgctctacttctgggtcagtgtctactttctattctatcttacccatcaggcaaatcaccaaagtctgcttcatggatcaaactcctcaagttttgcgcttttttctattggggaacaaaagtacctccaagcttctcttggctgtattctaccatgagctccagagcccccacgtcttcttaggggaaagttttattccacccactctggttcagtcagcttccttattgctgaatgaatctattggtgccaactatttcaacatcatggataacctcttgtatgttgtcctacaaggagaggagcccattgaaatacgctcaggtgtttccattcacttggccctcactgtgatggtttcagtcttagaaaaaggctgggaaatagtaatactcgaaagactaactaacttcttacagattggccaaaaccaaatcaggtttattcacgagatgcctggccatgaagagaccttaaaggccattgctgacagtagagcaaaaagaaagcgcaattgccctactgtgacttgcactagtcattatagaagagttggtcaacgtaggcctctcatgatggaaatgaactcacatagggcttcacccccaatgactgtggaaactatctcaaaagtgattgtcattgaaattggtgattcgccaacagtaaggagcactggaatgatttcatccttatcaagtaacaaattacagaatttggctcatcgagtcatcactgctcaacagactggggtactagagaatgttctgaatatgactatcggggccttactagttactcagtcaaagggagtcattggctatggaaatacaagcagttttaaaactgggaacttgatatatattcggccctatgcactttccatcctagtccagccttcagatggagaagtgggaaatgagcttccagtgcagccacaattggtatttttggatgagcagaatcgaagagtagagtccctgggacctccttcagagccatggacaatttcagcttccctggaaggagcatcagactcagtgctaaaagggtgcacccaggcagaaactcaagatggttatgttagcttctacaacttggcagtcttgatctctgggtcaaactggcactttatttttactgtcacttctcctccaggagtcaattttacagctcgatccaagccatttgctgtcttgcctgtgactaggaaggagaagtcgaccatcatcctggctgcttccctgtcctctgtggcctcatggctggctctgagctgtctggtgtgctgttggcttaaaagaagcaaaagcagaaaaacaaaacctgaagagattcctgaatcccagactaataatcaaaatattcatatccacatctcatccaaacgccgagaatcacaagggcccaaaaaagaagacactgtggtgggagaagatatgagaatgaaggtcatgctgggcaaggtgaaccagtgcccccaccagttgatgaatggagtgtccagaaggaaagttagccgccacattgtccgagaggaagaggctgctgtgcctgctcctggtactactggcatcacatcccatgggcacatctgtgctccaggtgctcctgctcagcaggtgtacctgcaagagactgggaactggaaggagggccaagagcagttgctcagataccagctggcaggccaaaatcagctgctgctgctatgcccagacttcagacaagagaggcagcagttgccagggcaaagtcggctgagtaagcaaagtggcagcttggggctttcccaagagaagaaagcctcctgcggggccactgaggcattctgccttcattcagtacacccggaaactattcaggagcaactgtgatcagggaagttgggggcatttggcctgaaaggcagaatgttcccagtatttctggataataagctggggaagtgaggactgtcctgctgggacaactaagaagagagaatgtggactctgaatccctttttcaactttaaaatggaaaacagtcatataaatgcttacagactgaaaaatgtctcatacatattttgcagctatcatgatcctagttcaatgctaggcaaataatggcacttgttaattatttaccagtttttaacttaagcctgattttaacaacttgataatggtgtaatactgacttataccagcaggggttattattaagcattctctggattgaccacccacaatgctttgagcttcttttatagaagggatcatgaaaaggtctggtcagctacagtttaattccacactgttacagaaaagcatttctttatcctgtagtagcatttgaagggacagttcaacaccctgctccctgatctgtcagagcttaccttccaaccacaaggcaacttcctggctttttacaagtggattttatttcatggtttaaattcaatcattattgagaacctacagtagtgtgagcgtatcaaatttgcacttcatgaggatttacacatgaaaattgatattctcatgggctttgctgagagtttagttaaggacaaagatgtaaaaatgccaaatttgggaaaggaaattttgtatgaccactgttctatttttcagtgattctctctgttagtagctgggtcacatttacaactggaaaagaactacattgggagatcagagaaagccaagtggccaagtcctttatcaaaaagctgctttttggagaagatgatgcataaagctgtgatactaaggagaggagagattatgtcatatgcaactgctctaggctgtgcagggggtttaaatggagatcagaacaaaggctcacctggtattgatacatttggtaaggttgttaaaggcaatttcaccaaattcacacatttgtacggggcccatttcttttcaaactgaagaatactttaaacagcctgactgtgtccttggctctggatccagaaggccttatgctccaagcatgtaaagaaaagatcgcaggaatgtggagagcttccaaaaagagattgctctcagattttcctgaaaatcctgaaaaccaggattttccaatctctacaatgttaaggggttgttgtgtagttgcattggaagagagaaaggaaacacactctttcattgctgaattctaaataatgatgccctgaattagttctatgagaagtactggcagacagctgttatgtctgcagggcatcaaggggcaggtgtgtctcaccctactaagaattggcagaaatgttttaacctcttctttaggcatctggtgagtattgcagatcttcaggctgtccctaaaaggaggtaggtagccttctctgtggtcactgtgttggatttggaagaaaatataagtagatgttaaggtcagtgctctccaggagatttcaatccaggctatctgtgttcagggaatgatttgcaagaagttggtttatagacgtttactctggaggcacaagctggctgccatgctgagtaagtcctctttgtagatgatgtattttgcttgggcaccaacagaattaaaaacgaaaaacaaaaaaaaactcgaatgacttaggcagaacatgccttccctagtttaattagtccctgttataaccagttatttatctttttttgtagattctcggtcttgaagtcatttgcctttgcaatctctactttagtatactcattggatcctcaaagagccgtaagctttttggaaaaaaacatttcagaagtgaaggcttttgaggtttataaaatggtagcagtcttagtccttgccctgcctcagtttacctgcacatgctttctttcatttcctcggattctttcaccactttttaagttttttttccacaggtatttttcctgagctctataccatgcatttagctgcctagtgagaatatccagtaggttatcctatagttactatgaagttaacacagcccaaaaacctacttctccttgtgtttttttccaactcaatgaatgacatcactgcactcagaccagaaatctagaagtcagtcatgactcttcattctatttcgcccttcacaaagagttagctgccagctctgttatttctgccccttctttacccttcttccaatttttattatcttcttatttatcctctatgtgtcacaagaccagtctttctgggaggcatgttttatcctatccctctgcgtaggaataaccataattatcttactaattccatcccagaaaagcctgtgatccctgaggccagaattgactctttgggcctaaatagcagctataaacatcttcagtaacttgccaggctctagcatgtggcatggaattttggcatctagctaaaattcctcaacccatagttaagctactcctctttctcctaaaaaaaaaaaaaaatgagagaattagggaaacaccaaaagcaaagagagcagctctatgttcattcatgtctggagatgagccaatttgagcaccactgtaggccaactctaaatttattcagatcgttaacatgggtaacccagcaaatatttcccagcagtgacaatctacaccctttatctaaataaatattgagatgtgcttttttcctgtgttagttcaaagaatctcttcttgcctcccattgctgattttctgtattgatggactcatttctctcaagagattggacaagctaaaattctagagagttcaaaagtgtttgaaagtacattttaagtgttctcaccacaaaaaatgctagtgtgtgaggtgatacatatgttaattagttcaactgatccattccacaatgtatacatatttcaaactatcgagttgtacatgataaatatatacaatttttatttgtcaaataaagaacatctataaatatttatagatttcaaaattgagaaagaagtatatatggagccacggttgttttgaccatttctccatgctttttgtttggggagggggacattttttggggggcagggactgtgttcagggaaagtacctgaccaacagaacttcaagtctcttccagagtgcgagactcagcttatctgatcaaggtgaacttgcccttcaatagacttgcccttgttactgcccagtgaggccaccaaggaccaagaacagttgagctctctcagggccttcccctttcaacaatttagttgaatgactcccttccatctatcagtcttactccaaatatatgaaattactatacattgaaatgcctgcaaactatatgcaaaaatgagtatgaggaaatcaaatgtaaatcatatgcaaatattattcaaccaagcttctataaaattgtacgtgtcaataacagtaaagaattttaattaattctgtcatttaaaattcatgcattccatattttgctttcagaacttatagtctatgccaattttgaaaaaactataagcacaaggaattaaatactattgagtatagaactgttgatttcaacatacactatagcactttgactaattacagatatatttgatagaaaagtcacatttctacaaggtaattttcaaaaagaaataaaacatttctgtaaacttaaatgtggattaagtggcagaatacagagatttgaatgtttacaaat

SEQ ID NO: 22942 - DNA, 10464 bp, Homo sapiens
acatttggctgggacacaaacgagttaggtgagttatagtctaacgtgagtgagttacctgcgtggtggctgcaggctgagctctaaccagataacatgtccacggattcttgacagagagaaataagatcacttagaaagaaaggatcatttctcccttgagtcacaaggagacagaaacagaaaaaaaagcacaaaagctatgctgctccaatcaaaactgaaaatgcttttaatgtctgagcaatcttaagagtattgatttaagtggacagaatgactgcctggctgatctctctgatgagtattgaagtactacttttggcagtacgtcacctgagtttacatattgaacctgaagaaggtagccttgcagggggaacgtggatcacagtcatttttgatggtttggagttgggtgttctttaccccaacaatggctctcaattggagatacacctggtgaacgtgaacatggtggtgcccgcactgcggagtgttccctgtgacgtctttcctgttttcttggatttgcctgtggtgacatgccggaccagatctgtgctgtctgaagcacatgagggtctgtacttcctggaagcatacttcgggggacagctggtaagcagtccaaatccaggaccacgagatagctgtactttcaagttttccaaggcgcagacacccatcgttcaccaagtttatccaccaagtggtgttccaggaaaactaatacatgtatatggctggattatcactggaagattggaaacttttgattttgatgctgagtacattgatagcccagtgatcttggaagctcaaggagacaaatgggttactccttgctctcttataaataggcagatgggaagctgttatcctattcaggaggaccatggtcttgggactctgcagtgccatgtggaaggcgactacatcggctcccagaatgttagcttctcagtatttaacaaaggaaagtcaatggtccacaagaaggcatggctgatcagtgctaaacaggatcttttcctataccagacacactcagaaatattatctgtgtttccagaaactgggagccttgggggaagaacaaacatcacaattacaggagacttttttgacaattctgcccaggttaccattgcaggcattccatgtgatattagacacgtgtctcccaggaagattgagtgcaccactcgggctccaggaaaagatgtgaggctcaccacccctcagccaggcaatcgagggcttctttttgaagttggagatgctgttgagggactggaactgactgaagccaccccagggtacaggtggcagattgtccctaatgccagttctccatttgggttttggtcacaggaaggacaacctttcagagcacggctcagtgggttctttgtggctccagagacaaataattacactttctggattcaggcagatagccaagcttccttgcatttcagttggtcagaggaaccaaggactaaggtgaaagtggcctccatcagcgtcggcactgctgactggtttgactcctgggagcagaatagggatgaagggacctggcagcagaagactcccaagttggagctgttgggtggagccatgtactacctggaagcagagcatcatgggatagccccaagcagggggatgaggattggtgtccagattcacaacacctggctgaatcctgatgtggtcaccacttacctacgggagaagcaccagatccgagtccgagcccagaggcttccagaagtacaggtgctgaatgtatcaggcagaggaaacttcttccttacttgggacaatgtctctagtcagccaatccctgcaaatgccacagcccatctgattcaaacaaccattgaggagttacttgcagtaaaatgcaaactggaacccctttggtctaacatccttctccggcttggatttgaacgaggcccagaagtttccaactctgatggggacctcaccagtgggacggagcccttctgtggcaggttcagcctccgtcagcctcgacaccttgtccttactcccccggctgcccagaagggctatcggctagatcagtatacacacctgtgtcttgcatacaaaggccacatgaacaagatcctgaagatgattgtgtccttcacaatcggctttcaaaacatggtaaagaataccacctgtgactggagtctcacgaggaccagccccgagagctggcagttcgattgcactgacctctgggagacttgtgtgcgttgcttcggggatctccagccccctccggcaaactccccagtgctggttcatcagatcaaccttctccctctggcccaggagacgggcctgttctatgtggatgaaattattattgcagacacaaacgtaacagtttctcaagctgattctggaacggctcgcccagggggcaatctggtggaatcagtctctgtggtgggatcccctccggtctacagtgtcacctcctggctggcggggtgtggcacggagctcccgctcatcactgcacgctctgtgcccactgaaggaacagaagagggatctggactggtcctggtgacgacacagagacgacagcggacaagtccacctctaggaggacactttcgcatccagcttcctaatacagtgatttctgatgtccctgtacaaatttctgctcatcaccttcaccagctcttacagaataatgccgatgacttcacatccaggtacctcaatgccagtgacttcactgtgaaggaggatctatacacttgctacgaacacgtgtggaccttgtcctggtccactcagattggggatttgcccaattttatcagggtctctgatgaaaaccttactggagtgaatcctgctgcagccacgcgtgtggtatatgatggtggagtttttcttggacccatatttggagacatgttggctactgccaaccagcatactcaggtggttgtgcgagtgaatgatgtaccagctcattgcccaggttcctgctctttccagtacctccaagggtcaactccctgtgtccattctgtgtggtactccattgatggtgacatcaacctaatgatttacattaccggaactggtttctctggtgactcccagttcttgcaggttacagtgaacaaaacgagttgcaaagttattttctcaaaccagaccaatgtagtctgtcagacagatttgctacctgttggaatgcatcggatcttgatgttggtgagaccctctggtcttgccatcagtgccactggagaagacctcttcctaaatgtgaaacctagactggatatggtggagccttccagagctgcggatattggagggctctgggccaccatccgaggctctagtttggaaggtgttagcctgatattatttggatcttactcgtgtgccatcaatgtcgctacaagcaattcaagcagaattcagtgcaaagttccacccagggggaaagatggacgcattgtgaatgtgactgtgatcagaggggactattctgcagttcttcccagagcatttacatatgtctcttccttaaatccagttattgtgactctgagcagaaacataagcaatatagcaggcggtgagaccctggtcattggagtggcgaggctgatgaactatacggatttggatgtggaagtccacgtccaggatgccttggctccggttcacacacagtcggcttggggcctggaggtggcactgcccccactgccagctggtctccacagaatttccgtctctatcaatggggtcagcattcactcacaaggggttgatctccacatccagtacctcacagaagttttcagcatcgagccttgctgtgggtccctgctgggagggaccatcctcagcatctcaggaataggcttcagcagggacccagctttggtttgggtacttgtgggcaatcggtcctgtgacattgtgaacttaacggaggcgagcatctggtgtgaaaccctgccagccccccagatacccgatgcgggcgctcccactgttccagctgccgtggaggtctgggctggcaacaggttcttcgcccgtggtccttcaccaagcttggtggggaaaggcttcaccttcatgtatgaagcggcagcaacaccagtagtcactgccatgcaaggagaaatcacaaatagcagcctgagcctgcatgtgggaggaagtaacctctccaactcagtcatccttctggggaacctgaactgtgatgttgagacacagtccttccagggcaacgtgagcctgtctggatgctccatccctcttcacagtctggaggctggcatctatcctctccaagtacgtcagaagcagatgggatttgctaatatgtctgtggtgctccagcaatttgcagtgatgcctcggataatggccatcttcccatcgcagggttcggcatgtggtgggaccatacttactgtgagggggttgcttcttaactctagaaggaggtcagttcgggttgacctctcgggtccttttacttgtgtgattttgagtttgggagaccacaccattctctgccaggttagcctggagggtgaccccttgcctggagcttccttctccctgaacgtcacagtcctggtcaatgggctaaccagcgagtgtcaggggaattgcactcttttcataagggaagaggcaagtcctgtcatggatgccttgtccacaaacaccagtgggtctctgaccactgtgctgattaggggtcagaggttagccaccacagctgatgagccgatggtatttgtggatgatcaacttccttgcaatgtaactttttttaatgcaagccacgttgtgtgccagacaagagacttggccccaggaccccactacctgtcagttttttatacaagaaatgggtatgcttgttctggtaatgtttccagacacttctacattatgccccaagtgtttcattattttcctaagaatttcagcttacatggtggaagcctcttgaccatagagggcacaggcctgagaggacagaacaccacgtcagtctatattgaccagcagacctgcctgacggtgaacatcggtgctgagctcatccggtgcattgttcccacagggaatggctctgttgccctggaaatagaggtagatggactttggtatcacataggagtcattggttataacaaggcctttaccccagaattgatctctatttctcagagcgatgacatcttaacctttgcagtggcccagatctcaggagctgcaaacattgacatttttataggaatgtcaccctgtgtgggtgtctctggtaaccacaccgttcttcagtgcgtggtcccttcccttccggccggggagtaccacgtcagaggctatgactgcatcagagggtgggcctcatctgccctggtgttcacctcaagagttattattacagcagtgacggagaacttcggctgcctgggtggaaggctggtgcatgtgtttggagcgggattttctccagggaatgtctcagctgctgtgtgtggtgctccctgccgagtcctggctaatgctacagtgtctgccttcagctgcttggttctgcccctggatgtgtccttggccttcctgtgtggcctgaagcgtgaggaggacagctgtgaggctgccagacacacctatgtgcagtgtgatttgacagttgccatggcgacagagcaactgcttgaatcgtggccttacctctacatttgcgaggaaagttcccaatgcctctttgtgccagatcattgggcagagtcaatgtttccatcattctcgggcctctttatcagccctaaattggaaagagatgaagttctcatctataatagctcctgtaacattaccatggaaactgaggcagagatggagtgtgagacgcccaatcagccaattaccgtcaagattactgagatacggaaacgctggggccagaacactcagggcaacttttctttacagttctgccggagatggtccaggactcacagctggtttcctgaaaggctgccacaagatggcgacaacgtcacagtggagaatggccaattgcttctgctggacactaacacaagcatcctcaacttactgcacattaaagggggcaagctgattttcatggccccaggacccatcgagctcagggcacacgccatccttgtttctgatggtggagagctccggattggatccgaagacaagcccttccaaggcagagctcagatcacactctacgggagttcctactcaactcccttctttccctatggagtcaagttcctggctgtgaggaatggaactctttctctgcacggttcactaccagaagtaattgtcacctgtcttagagcaactgcccatgccctagacacagtgctggctttagaagatgctgtggactggaaccctggggatgaagttgtcatcatcagtggaacaggtgttaaaggtgccaaaccgatggaagagattgtcactgtggaaactgtgcaggatacagacctctatcttaagtcacctttgagatattctcacaactttacagagaattgggtggctggagagcaccatattttaaaggccactgtggctctgctcagcaggagtattaccatacaaggaaatctcactaatgagagggagaagctgcttgtttcatgccaggaggccaatgctccagaaggtaatctgcagcactgtttgtattccatgagtgagaagatgctaggatccagggatatgggagccagagtgatcgttcagtccttcccagaagagcccagccaggtccagttgaagggagtgcagtttcaagtcttggggcaagccttccataagcatctgagctcactcactctggtgggagctatgagagagtctttcatacagggctgcacagtgaggaactccttcagtagaggcctcagcatgtgcgggaccttgggcctgaaggtggacagtaatgtattctacaatattttaggtcatgcgctgctagttgggacatgcacggagatgagatatatctcctgggaggcaattcatggaaggaaagatgactggtcaggacatggaaatataataagaaacaacgtgatcatccaggtttctggtgccgagggactctccaatcctgaaatgttgacaccatctggcatctatatctgcagtcccaccaatgttatagaggggaacagagtgtgtggtgctggctatggctactttttccatctcatgaccaaccaaacatcacaagctccgcttctttccttcactcagaacattgcacattcttgtaccaggtatggtctctttgtataccctaaatttcagccaccttgggataatgtcactggcaccactctgttccagagcttcacagtttgggaaagtgcaggtggtgcccagatttttagaagtagcaatcttcgcctgaaaaacttcaaagtttattcatgcagagattttggaattgacgtcttggaaagtgatgcaaatacttcagttactgacagcttattacttggtcattttgcccacaagggaagtctgtgtatgtcatctgggattaaaactcctaaaagatgggaactgatggtgtctaacacaacctttgttaattttgatctcatcaactgtgtggccattagaacctgttcagactgttcccaaggacaaggtggatttactgtgaagaccagccagttgaagtttacaaactcttcaaacttagtggcatttccatttcctcatgcagcaattttggaagacttggatgggtctctgtctgggaaaaacagaagtcacattcttgcttctatggaaaccctttcagcttcttgtttggtcaattcaagctttggtcgggttgtccatggcagtgcctgtggaggaggtgttctttttcatcgtatgtctattggtttagcgaatactcctgaagtttcttatgatttaaccatgactgacagcagaaataaaacaaccactgtcaattatgtacgtgatacattgtctaaccctcgtggctggatggctctgctcttggaccaagagacctactcattgcaatctgagaacctttggatcaacagatctctgcagtactcagcaacctttgacaactttgctcctggtaattacctactgctggtgcacacagatttgccgccttaccctgacatcctcctaagatgtgggagtcgagtgggtctgtcttttccatttcttccatcaccaggtcagaaccaaggctgtgactggttcttcaatagccagctgaggcaactcacctatctggtttcaggtgaaggccaagttcaagtcattctccgggtgaaggaaggtatgcccccaactatttcagcttctacctctgcccctgaatcagctttaaaatggtccctccctgaaacatggcaaggtgttgaagaaggctggggaggatacaacaataccattccaggccctggggatgacgttctcattttacccaacagaactgtccttgtggatacagatcttccattcttcaaagggctgtatgtgatggggaccttagacttccctgtggacagaagcaatgttctgagtgtggcatgcatggtcattgcaggcggggagctgaaagttggtactttagaaaatcccttagaaaaggaacaaaagcttctgattctccttagagcctcagagggagtcttttgtgaccgtatgaatggaattcatattgacccaggaacaattggggtttatgggaaagttcatctttacagtgcttatcctaagaactcctggacacatcttggagctgatattgcctcaggaaatgagagaattatagtagaagatgcagtggattggcgcccccatgacaaaatagtccttagctcctcttcttatgagcctcatgaagcagaggtcctcactgtgaaagaagtcaagggccaccatgtgaggatctatgaacggctcaaacaccggcatattggaagtgtacatgtcacggaggatggccgacacattcgtttggctgctgaggttggactgttgacccgaaatatacaaattcagcctgacgtatcatgtagggggagactgtttgtggggtccttcaggaagtccagccgagaagaattttcaggtgtccttcaacttcttaatgtggaaattcagaacttcgggtcaccattgtactcatctgttgaattcagtaatgtgtcagcaggatcctggatcatatcatctactctgcaccagagctgtggcgggggcattcatgcagctgccagtcatggagtacttttaaatgacaatattgtgtttggcacagctggccatggcatagatttagagggtcaggcctatactgtcactaataaccttgtggttctgatgacacagccagcgtggtccaccatttgggtggcgggaatcaaagtgaaccaggtaaaggacatcaacctccatggcaacgttgtggcaggatcagagagacttggctttcacatccgaggccacaagtgctcctcttgtgaactgctttggtctgacaatgtggcgcattcaagtcttcatggccttcatctctataaggaaagtggacttgacaactgtaccagaatctctggcttcttggctttcaagaactttgactatggtgccatgttacatgtagagaacagcgtggagatagagaacattactctggtagacaatactattggtcttttggcagtagtgtatgtattttctgctccacaaaattccgtcaaaaaagtgcagattgtgcttaggaattcagtcattgtggccaccagctcttcttttgactgcattcaggacaaagtgaagccgcactcagccaacttgacatcaacagatagagctccctccaatccaagaggaggtcgaattggtattctgtggcctgtattcacctcagaaccaaatcagtggcctcaggagccatggcacaaagtgaggaatgatcattcaatttcaggaatcatgaaacttcaagatgttaccttttctagttttgtgaagagttgctatagcgatgacctggatgtctgcattctaccaaatgcagagaacagtggaattatgcacccaataacagcagagaggaccaggatgctaaagataaaagataaaaacaagttctactttccttcattacaacccaggaaagatttaggaaaagtagtctgtcctgaattagactgtgcaagtccaagaaaatatctcttcaaggatctggatgggagagccctgggtctgcctccaccagtttctgtatttcctaaaacagaggcagaatggactgcatccttcttcaacgcaggcacaaaagaacaaagcattgaaattaatgtc

SEQ ID NO: 22943 - DNA, 13076 bp, Homo sapiens
gggacgaagcgggcccgccagcgagtcgcagtcccaggagccgagctccagcactagagccagctgcgagcggagggcaccaactccgcagaactggcttttcaatgggacacctgtggctcctgggtatttggggcctctgtgggctgctcctgtgtgccgcggatcccagcacagatggctctcaaataatccccaaagtcacagaaataatacctaaatatggcagtataaatggagcaacaaggctgactataagaggggaaggtttttctcaagcaaaccagtttaactatggagttgataacgctgagttgggaaacagtgtgcaattaatttcttctttccagtcaattacttgtgatgtagaaaaagatgcaagtcattcaactcaaattacatgctatactagagcaatgccggaagattcctacactgttagagtcagtgtggacggggttcctgttacggaaaataacacctgcaaaggtcacatcaacagctgggaatgtaccttcaacgcaaaaagttttagaaccccaacaataagaagcatcacacctttatctggaactccaggtacactaataacaatccaaggcagaatcttcactgatgtctatggaagtaatattgcactaagctcaaatgggaaaaatgttaggattttgagagtttacattggaggaatgccctgtgagcttctcataccacaatctgataatttatatggtctaaaactggatcatccaaatggagatatgggttctatggtttgtaagacgactggaacttttattggtcatcacaatgtcagcttcatcttagataatgattatggaaggagttttccacagaaaatggcatattttgtttcttctctcaataaaattgcaatgtttcaaacatatgcagaggtcaccatgattttcccttcacaaggaagcattcgaggtggcaccacgctgacaataagtgggcgtttctttgatcagacagatttccccgtcagagttctagttggaggtgaaccttgtgatattttgaatgtcacagaaaatagtatatgttgcaagacaccccccaaacctcatattctcaaaactgtatatccaggagggagaggcctgaagcttgaggtgtggaataatagccgtccaatacgtttggaagagatactggaatacaatgaaaaaacgcctgggtacatgggtgccagttgggtagattcagcttcctatatttggctcatggaacaagacacatttgttgcacgctttagtggatttttggtggctccagattctgatgtttatagattctacatcaagggtgatgaccgttatgctatttattttagccagactggacttccagaagataaggtgaggattgcatatcattctgctaatgccaacagttatttttccagtccaacacaaagatcagatgatattcatctgcagaaaggaaaagaatactatattgaaatcttgctgcaggagtacagattaagtgcatttgttgatgttggactgtaccagtatcgaaatgtttatactgaacaacaaacaggagatgcagtgaatgaagaacaagttatcaaatcccagtcgacaatcctccaggaagtacaggttataacattggaaaactgggaaacaactaatgcaattaatgaggttcagaagatcaaggtaaccagcccatgtgtggaagctaattcatgttcactttaccaatatagattaatctataatatggaaaaaactgtcttcctacctgctgatgcttctgaattcatactgcaatcagccttgaatgacctctggtctataaaaccggacacagttcaagtaataagaacacaaaatccccagagctatgtctacatggtaacattcatatcaactagaggagactttgatctgcttggttatgaagtagttgaagggaataatgtcacactggatattacagaacaaaccaaaggaaaacccaacttggagacattcacactgaattgggatgggatcgcttctaagccactcactctatggtcatcagaagctgaatttcagggagcagtggaagaaatggttagcactaagtgtccaccacaaattgcaaattttgaagaaggatttgttgtgaaatatttcagagactatgaaactgattttaatctggaacatattaacagagggcagaagacagctgaaaccgatgcttactgtggtcgttattccctgaaaaacccagctgttctttttgactcagcagatgttaaaccaaacagacgaccatatggagatattttattgtttccttataatcagttatgtttagcatacaaaggattcctggcaaattatattggtctaaaatttcagtaccaagacaatagcaagattactagaagcactgatacacagtttacatacaactttgcttatggaaacaactggacttacacttgcatagaccttctggatctcgtaagaacgaaatacactgggacaaatgtttctcttcagaggattagcttacataaagcatcagaatcacagtccttctatgtggatgtagtgtacattggacacacatctacaatctcaacattggatgaaatgcccaagagaagacttcctgcattagcaaataaaggaatattcttagagcactttcaggtgaatcagaccaaaacaaatgggccaactatgacaaaccaatattctgttaccatgacttcatacaattgcagttacaatatacccatgatggctgtgagctttgggcagataatcacacatgagacagagaacgagtttgtctacagaggaaataattggccaggcgagtcaaaaattcatattcaaagaattcaagctgcatctccacctctaagtggcagctttgacattcaagcttatggacatattcttaaaggcctccccgctgctgtgtcagctgcagatctgcagtttgcactccagagtctggagggaatgggaagaatctcagttacacgagagggaacctgtgctggctacgcgtggaacatcaaatggagaagcacctgcggaaagcagaatcttctacagattaatgattccaacattattggagaaaaggctaatatgacagttacaaggataaaggaaggtggcttattcagacaacatgtacttggagacctacttcgtacacccagtcaacagccacaggttgaagtctatgtcaatggaattccagctaaatgttcaggtgactgtggatttacatgggattccaacattactcccctagtcttggcgataagcccttctcaagggtcctatgaagaaggcacaattctaaccatagtgggttctggattttctcctagttcagctgtaacagtctcagttggaccagtaggttgttctcttctttctgtggatgaaaaagagctcaagtgccagattctgaatggaagtgctggacatgcccccgttgctgtgtccatggctgatgttggactagcacagaatgtagggggtgaagagttctactttgtttatcagagtcagatctcacatatctggcctgattctggaagcatagcaggtggtactctactgactttatctggatttggctttaatgaaaattcaaaggtattagttggaaatgaaacctgcaatgtgattgaaggggatttgaataggataacctgcaggacaccaaaaaaaactgagggtacagttgatatttcagttactaccaatggatttcaagccacagcaagggatgcttttagttataattgtttacagacaccaattataactgattttagtccaaaagtacgaacaatactaggagaagttaatttaacaattaagggctataattttggaaatgaactcacacaaaacatggcggtgtatgttggaggaaaaacctgccagattcttcactggaacttcacagatattagatgccttttgcccaagttgtctcctggaaaacatgatatctatgtagaagtcagaaactggggttttgcatcaacaagagacaaattaaattcttcaatacagtatgttttagaagtgaccagcatgtttccacaaagaggctccttgtttggtggaactgaaatcaccataaggggttttggattcagcacaataccagctgagaataccgtgctgttagggtccatcccttgcaatgttacatcatcatcagaaaatgtcataaaatgtattcttcattcaactgggaatatattcaggattaccaacaatgggaaagattcagtacatggattaggttatgcctggtcaccaccagtcctaaatgtgtctgtgggggacacagtggcatggcattggcaaacacatccgtttcttagagggataggatataggattttttctgtctccagtcctggaagtgtaatttatgatggcaaaggattcacaagtggaagacaaaaatctacatcaggttcattttcttaccaatttacttctcctggaatccattattatagcagcgggtatgttgatgaggctcactccatttttctccaaggagtcattaatgttttaccagctgaaaccagacacattcccttgcacctgtttgtgggtcgctctgaagccacatatgcttatggaggacctgagaatttgcacttgggaagctctgtggcaggctgcctagcaacagaacccctgtgcagcctgaacaataccagggttaaaaattcaaaaagattgctatttgaggtttcaagttgtttttcaccatctataagcaacattactccgtccactggaacagtaaatgaactaataacaattattggacatggctttagtaatctcccatgggctaataaggttacaattggtagctacccctgtgtcgtagaagaaagtagtgaggattcaattacatgtcatattgaccctcaaaactcaatggatgttggtatcagggaaactgtcactttgactgtctacaacctgggcactgctatcaatacgttgtccaatgaatttgataggcgatttgtacttttgccaaacattgacctggtgttgccaaatgcaggatcaactacaggaatgacaagcgtgaccataaaaggctctggatttgccgtttcttctgcaggtgtaaaagtccttatgggtcatttcccatgtaaagttctatcagtgaattatacggccattgaatgtgaaacatcccctgctgcccaacagcttgtggatgtagatcttctaatacatggagtgcctgcccagtgccagggaaactgcaccttttcatacttagaaagcatcactccttacataacaggagtcttcccaaactctgtcataggatctgtaaaagttcttattgaaggagaaggtttggggactgttttggaggacattgctgttttcattggaaatcaacagttcagagcaatagaggttaatgaaaacaacatcactgctcttgtgactcctctcccagttggacatcattctgttagtgttgtggtgggaagtaaaggcttggctctgggaaacctgactgtcagcagccccccagtagcatctctatcaccaacttctggaagcattggtggtggaactacactggtgatcacaggaaatggcttctatccaggcaacactacagtcactattggggatgaaccttgtcaaattatttccatcaaccccaatgaagtctactgccgcactcccgctgggaccactggaatggtcgatgttaaaatctttgttaatacaattgcttatccacctttgctttttacatatgccctggaggatactccatttctcagaggaattatcccaagcagaggtccaccaggaactgaaattgagatcactggatccaactttggctttgagatcttggaaatctccgtgatgataaataacattcagtgtaatgtaaccatggccaatgatagtgtggtgcagtgcatcgtgggagatcatgctgggggcacatttcctgttatgatgcatcataagacaaaaggctcagccatgtccacagttgtatttgagtacccgcttaatattcaaaatattaatccaagccaagggagctttggtgggggtcaaaccatgactgtgacaggcaccggatttaatccacaaaattcaattatattagtttgtggctcagaatgtgcaattgacaggcttagatctgattacacaacactattatgtgaaattccatctaataatggcacgggagctgagcaagcctgtgaagtgagtgtggttaatgggaaagatttgtcacagtccatgactccgtttacgtacgcagtgtcactgactccactcatcactgcagtatctcctaagagaggcagtacagcagggggcaccagactgacagtcgtgggatcaggattcagtgaaaatatggaggatgttcatatcaccatagctgaagccaaatgtgatgttgagtattccaacaagacacacatcatctgcatgacagatgcccatactctatcagggtgggctccagtttgtgtccacatcagaggtgtcggcatggccaaactggataatgctgactttctttatgttgatgcctggtcctccaatttctcatgggggggaaaatctcccccagaagaaggatctcttgttgttattacaaaaggacagaccattctgctggatcaaagcacccctattttgaaaatgttgcttattcagggtgggactctaatatttgatgaagctgacattgaactccaggcagaaaatattctaattacagatggaggtgttcttcagattggaacagagacatccccattccaacacaaggctgtcattaccttgcatggtcacctgcgatctcctgagctccctgtctatggtgccaaaacactggctgtgcgggagggaatcctggatctgcacggtgtgcctgttcctgtgacctggactcgcttggctcatactgcaaaggcaggggaaagaattttaattttacaagaagcagtaacatggaaaccaggagataacattgtaattgcaagcacaggacacagacacagtcaaggagagaatgaaaaaatgaccattgcatctgtgtctgctgatggcataaacataacactaagtaacccactaaattacacacacttaggaattacggtcacactccctgatggaactctgtttgaagcaagagcagaagttggaattcttacaagaaatattttaataagaggatctgataatgttgagtggaataacaaaattcctgcatgtcctgatggatttgacacaggagaatttgctacacagacctgtctccaaggaaagtttggagaagaaataggaagtgaccaatttggaggctgcgttatgtttcatgctcctgtacctggtgctaacatggtaactgggagaatagaatatgtagaggtattccatgctggccaggctttccggttggggcgatatccaatacattggcacctgcttggagacttacagtttaaatcttatgtaagaggctgtgcaattcaccaggcctataacagagctgttactattcataacacacaccatcttctggttgagaggaatattatatatgatattaagggaggagcattttttatagaagatggtattgaacatggcaatatcctccagtataacttggcagtatttgtacagcaaagtaccagtcttctgaatgatgatgtgaccccggctgcattttgggtcaccaacccgaacaataccatacgacacaatgctgttgctggtggcactcactttggcttttggtaccggatgaacaaccaccctgatgggccatcctatgacagaaacatttgtcaaaaaagagttccccttggcgaattttttaacaatactgtccattctcaaggttggtttggaatgtggatctttgaggaatatttccccatgcaaacgggatcttgtacatctacagtgcctgcacctgcaatatttaactcacttactacttggaattgtcaaaaaggagctgaatgggtcaatggaggtgcccttcagttccataactttgtgatggtgaataactatgaggctggaattgagactaagaggatcctggctccttatgttggagggtggggtgaaaccaatggagcggtgattaaaaatgccaaaatagtcggccatcttgatgaactgggaatggggtctgcattttgcacagcaaaaggcctggttctcccatttagtgaaggcttgactgtctcttctgtgcactttatgaactttgaccgtcccaactgtgtagctttgggagtgacatccatctctggagtttgtaatgacagatgtgggggttggagtgcaaagtttgttgacgtccagtattctcacacaccgaacaaggctggctttcgctgggaacatgaaatggtaatgattgatgttgatggctcacttacagggcacaaaggacataccgtcattccacacagctcattgctagacccttctcattgtactcaggaagctgagtggagcattgggttccctggatcagtctgtgatgcttcagtcagctttcaccgtttagcgttcaaccagccttctccagtatctctgcttgaaaaggatgtggttctttcagactcttttggcacaagcattattccatttcagaagaaacgactgactcatatgtctggatggatggctctgattccaaatgcaaatcacattaactggtattttaaaggtgtggatcacataaccaacatttcatatacatcgacattctatggattcaaggaagaagactatgtaattatatcacataacttcactcaaaatcctgacatgtttaatattattgatatgaggaatggttcctcaaatccattgaattggaatactagcaagaatggggactggcaccttgaagcaaacactagtactctatattacttggtgtcaggaagaaatgaccttcatcagagtcagctcatttctgggaacctggatcctgatgtgaaagacgttgttattaatttccaagcttactgttgtattctccaggattgctttcctgtacatccgccatcaagaaaaccaattcccaagaagcgaccagccacatataatttatggtcaaatgattctttttggcaatcatcacgagaaaataattatactgtacctcacccaggggcaaatgtgattatacctgaaggaacatggattgtagctgacatagatatgccatcaatggaaagactcattatttggggggttctagaactggaagataaatacaatgtaggagctgcagaatcttcttacagagaagttgttttgaatgctacctacatatcactgcagggaggtagattaatcggtggctgggaagataacccttttaaaggagacttaaagattgttcttagaggaaatcatactacacaagactgggctcttccagaaggaccaaatcaaggggcaaaggtcttaggggtgtttggtgagctggatcttcatggaattccacattcaatatataaaactaagctctcagaaactgcatttgcaggttccaaagtcctgtctctgatggatgctgtggattggcaggagggagaagagattgtgataacaaccacaagctacgatttccaccagacagaaacaagaagtatcgttaaaatcctgcatgatcataaaattctcattcttaatgatagcctttcctatactcactttgctgaaaaataccatgtccctggaactggtgagagctacacgttagcagctgatgttgggatactgagtaggaacatcaaaatagttggtgaagattaccccggttggtctgaggactcttttggagcacgcgtactggttggctcattcactgaaaatatgatgacatttaaaggaaatgcaagaataagtaatgtggaattttatcacagtggtcaagaaggcttcagggatagcacagatccaagatatgctgtaacgtttcttaacctaggacagattcaagaacatggctcatcttatattcgaggctgtgcttttcaccatggcttctctccagcaattggtgtatttgggacagatggattggacatagatgacaacatcattcactttacagtgggggaaggcataagaatatgggggaatgccaaccgagtccgagggaatttgattgcactttcggtttggccaggaacctatcagaacagaaaagatttaagttcaactctctggcatgcagcaattgagataaatagagggaccaatacagttttacagaataatgtagtggctggatttggaagagcaggataccgcattgatggtgaaccttgcccaggccagtttaatcctgtggaaaagtggtttgacaatgaagcccatggaggtttatatgggatctatatgaaccaagatggccttcctggatgttctcttatacaaggatttaccatttggacatgctgggattatggaatttattttcagaccacagagagtgtgcacatttataatgtgaccctggttgacaatggaatggccatttttccaatgatttacatgccagctgctatatcacacaaaatttccagtaaaaatgtacaaattaagagctcattaattgttggaagtagccctgggtttaattgctctgatgtcctaactaatgatgatcctaatattgaactcactgctgctcatcggagtcctagatctccatcaggtgggagaagtgggatttgttggcctacctttgcttcagctcataacatggcaccccgaaagccccatgcaggaatcatgagttacaatgccatcagtggccttttggacatctcaggttcaacatttgttggatttaagaatgtttgttcaggggaaactaatgttatattcattactaaccctttaaatgaggatttacagcatccaatccatgtgaagaatataaaactggttgataccactgaacaatcaaaaatatttatacataggcctgatataagtaaggtcaatccatctgattgtgtagacatggtttgtgatgccaagaggaaatcttttcttagagacatagatggctcctttctggggaatgctggttctgtgatacctcaagcagaatatgaatgggacggaaacagccaagtaggaattggagactacagaattcctaaggcgatgctcacattcttgaatggaagtagaattcctgtcactgagaaagcacctcataaaggaattattagagattcaacctgtaagtaccttccagagtggcagagctatcagtgctttgggatggaatatgcaatgatggttattgaaagtctggatcctgacacagaaactcgaagactttccccagtggctataatgggcaacggttatgttgatcttattaatggcccacaggatcatggctggtgtgctggatatacatgccagagaaggctgtccctgtttcacagcattgtggctctgaacaaatcttatgaagtttacttcactggcaccagtcctcagaatcttcgactgatgttgcttaatgttgatcataacaaggctgttctagtaggaattttcttttccacacttcaacgtttggatgtctatgtgaacaacttattggtctgtccaaaaactacaatatggaatgcccagcagaaacactgtgaacttaataaccatctgtacaaagaccaattccttcctaacctggattccactgtccttggtgaaaactactttgatggaacctaccagatgctttatcttttggttaaaggaactatacctgttgaaattcacactgccacagtgatatttgtttctttccaattatctgttgcaacagaagatgacttttatacctctcacaatctggttaaaaatcttgccttgttcctaaagataccaagtgacaaaatccgtatcagcaaaataagagggaagagtctgaggaggaagagatccatgggattcataattgaaatagagattggagaccctcctattcagttcataagcaatggcaccacaggtcagatgcagttatctgaactccaggaaattgctggttctcttggacaagctgtaattttaggaaacatcagtagtatccttggatttaacatttcgtccatgtctattactaatcccctccccagcccaagtgactctgggtggattaaggtgactgcccagccagttgaaaggtctgcatttcctgttcatcacgtggccttcgtgtcctcactcttagtgatcactcagccggtggcagcacagccaggacagccatttcctcagcagccttcggtaaaggcaacagattctgacggtaactgtgtatcagttggaattactgcactaactttgagggccatactcaaggactccaataataaccaagtcaatggccttagtggaaatacaacaattccgtttagcagctgttgggccaactacacagaccttactccccttagaacaggaaaaaattataagattgaatttatactggataatgttgttggggtagaatccagaactttcagcctgctggcagagtctgtctctagcagtggcagcagcagcagcagcaacagcaaagcatcaactgtgggtacatatgcccagataatgactgtagtaattagctgtctggttggaagaatgtggctcttggaaatatttatggctgcagtttcaactttgaatataactttaagaagctactaaagtgctgttccgaagaataggctgaaacaaaaatataagaattattagctactttgttgggcaataggcaaaagtctatagcattttcatgaaaatatactaaaaatatttttatgatatataaaatgtactaattagctttaaacactaaaatcagatttcttcaaaatataaatttgttttgattctttatatttatatgtttttatttcatttcaataaacttccagaaatttgtca

SEQ ID NO: 22944 - DNA, 7660 bp, Homo sapiens
atgaggcctgggcccgctctcctccttctgggcgtgggcctgagcctgagcgtcggccgcctcccgctgccgccggttcctcgcggggcacaagccgccgtctccggggcgcccggtggcctcctcaggggcgccccgggcctcggggtgcgcggcggccgcgccctcctcagtctgcggcccagcgcggtgcgggcgggcggcgctgtcctgagcggccgcggcagcctctgcttcccccatggcgggaccgggcggcgctggtactgcctcgacttgcgcgtcctgctcagcgcccaacgcctgccctggccggccgcgcccgcgctcgcgctcgtcgacctgcagctctccgcgcgcggcggccgcctctccctgacgtggtccgtgcggctgccgcgctcgcccgggcgcctggcctgggccttccgcctgcggctgctcggacccggcgccgcccgcccggcctcccccgcggcccgcgtctccccgcgctccgccgcgccaggcccgcggccccagcagggcttcgtggcccgcaccgagtgccccacagacggccccgcgcgcgtgatgttgcaggccgtcaactcgtccagccacagagccgtcgagtcgtccgtgtcctgtcagataaacgcctgcgtcatccagcgcgtgaggatcaacacggaccagaagggcgcccccgtgcgcctgagcatgcaggcggaggccaccatcaacgcctcggtgcagctggactgcccggccgcgcgcgccatcgcccagtactggcaggtgttctccgtgcccgccgtgggtcaggcgcccgactggacgcagcccttggatctgccccagctcgagatcaggaacagccccttgttcattcacatccccaataattcgttacagtggggagtgtatgtgtttaatttcacggtgtccatcaccacagggaaccccaagatgcccgaggtgaaagactcggacgccgtctatgtctggatcgtcaggagttccctgcaggcggtgatgcttggcgatgccaacataacagctaatttcacagagcagctgattctggacgggtccacgtcctcggacccagatgcggacagcccgttacagggactccagttcttttggtactgtaccacagatcccagaaactacggtggggatcgaataatcctggggagcaaggaagtctgtcaccccgagcaggccaatctgaaatggccctgggcctcgggccctgtactgacacttttgccagaaacacttaaaggcgaccacgtgtatttcttcagaatggtgattcggaaggactctaggacagcgttttctgataagagggtccacgtgctccaaggaccaaaagccatagcacacatcacatgtatcgaaaattgtgagagaaacttcattgtctctgatagattttctttgttcctaaattgcacaaattgtgcaagccgtgatttctataaatggtcaattttgtcttcttcaggtggtgagatgctatttgattggatgggggaaactgtaacaggaaggaatggtgcttatctgtctataaaagcttttgcttttcggcattttttggaagctgagttttcgatttctctgtatctagcatgttggagtggagtgacctcggtcttcaggcattcttttattattaaccatggccctcagatcggagaatgcaaaattaatccagctaaaggaattgcacttattactaaatttgttgtccagtgtagtaattttagggataagcacgtccctcttacatataaaataattgtttctgatttgcacagtgttggtgaaatcagttcagtaaaagagaacaccctggggaccatcctgtacttggggcctcagtccacagtacccccttcctttctccctgttggtatgttggctagtcaatatggcttgaagatatatgcccaggtctatgattctctaggagctttttctcaggtgactttgcatgccaccgcacaggctcccactgacaaaaattcatcaaagacagtgttgaatcagttactcagtttcaccgtgggaccaagttcattgctgtctactttgattcaaaagaaggattttttacctgcaggttacttactgtatatagtagcttccgttttgaataacatgaaaactgaattacctctccgagatgacagagtcaatctccgaaaacacctcatcgatcagtctttccttcttcctgtaagcactttggtagaaattggccaggtagtcatgactattaccaaattaacccagaaaccctctgaattcacttgggatgctcagaaacgtgccaccatgagggtatggcaagcaaatcaagccctacaagagtatcagcaaaaagataaacgctttcgatctgaacaaatagaaatcgtgagtactggaatactaatgagtttgtctaatattcttaaaatgacttctcctcaccaagtagttaaagatcctttctatgtaatagaatctctatcagacacaatactggctaataaagtgccagggaacaaaaccacctcaatgagaacccccaatttcaacatgtatgtcaagaaagttgaaaagtggggtatcaaccagctcttcagaaatgagaaacactgcagaaattgtttttatccaacactcaatgtgagcagtgttcctggtctgtctgcaaatggtcccatttctacaatgttttgtgatttcacaaatgacctctttccttggttaaatgatcaggaaaacacttcggtggaggtgtctggattcagaatgacaggagttgcagataacggtagtgtgctagagatcacacctgatgtagcggaagtgtaccttgtcaggaaaaacttgacctttgcagcttttaatctcacagtgggacccaacagcgaggttgatgggtccttgaagaagacgacaggtgggtttagctttcaagtggacagcacagtgcttagggaggttctggtccacatagtaacagaagtgatggtgctgttcacagtgttggtgtacacaggcagtcagatcactcccacagcgctggtcgccaccttcctggtgcctcatgacatccctccatttgccagccagagtgccctgtttgacccagcctgcacagtgaagaaggcccgtgtagtctgcctccctgtgtccctgctgcaactcatagctcagcacagccactctccccactgtactgtatccatagttctgcaggcacctcgttttgtcatgaagctcaatgacaagctagtgagaatttctattttcagcgtccagtgcttggacatgtatgggatccagagtgaatggagagagggttattgcattcttggtgagaagaccagctggtatgaggtgcactgcatctgcaagaatgtagtaagggctaggcggcagctgggcacaatcggactcacgggcattcacctgcatacccactatgtgatggccaaggtgattgtgatccctaatcctgtggatctacggttaaacatcatcaagagccttcaccaaaaccccgtgaccctcttcactgtgcttttcattattctcttatacgtgggcctagctttttgggctttatacagggatgaaatggaccagcatcttcgggggcatgtgatagttctaccagataatgatccttatgataatttatgctacttggtgactatttttacaggaagtcgttgggggtctgggaccagggccaatgtctttgtgcaacttagaggaactgtgagtaccagcgacgtgcattgtttaagccatccacatttcacaactctctaccgaggtagcatcaacactttcctcctaacgacaaaaagtgacttgggggacatccattccatccgtgtgtggcacaacaacgagggtcgatcgcctagctggtatttaagtagaatcaaagtggaaaatctgtttagcaggcacatttggctgttcatatgccagaaatggctttctgttgataccactttggacagaacatttcacgttacccatccagatgagcgtctgactagaaaagactttttctttatagatgtgagtagtaatctccggaaaaaccacatgtggttctctatttttgctagtgttgttgctaaaacattcaataggctccagagattgtcctgttgtttagcaatgttgcttagctctcttctttgtaacattatgttctttaatctaaatagacaagaacaaactgagtcaagagagaggaaatacatgagatcaatgatgataggaattgaaagtgtcttaattacaatccctgtgcaattattaataacttttttgttcacctgttcccagaggaaacctcaagcggatctaaaggaggtatctcctcaaaagcatcctctaatgtcagaagcaagtgagcactgggaagaatacttgagaaagtggcatgcttacgaaactgctaaggtgcaccccagggaggttgcaaaacctgcatctaaaggaaagcccaggcttccaaaggcttctcctaaggcaacctccaaacccaagcacaggcataggaaagcacaaatcaagaccccggagaccctcgggccaaatacaaattccaataacaacatagaagatgatcaggatgtccattccgaacagcacccttcccaaaaggatctccagcagcttaagaaaaagccccggatcgtcctaccttggtggtgtgtttatgttgcatggtttttggtttttgctacttctagcatatcctcattcttcattgtattttatggactgacttacggctatgacaagtcaatagaatggctctttgcatctttttgttcattctgtcagtcagttcttctggtgcagccatctaaaattatactcctgtcaggcttcagaacgaataaacccaagtattgcaaaaacctttcatggtcaaccaagtataaatatactgagatcaggttggatggaatgcgtatgcatccagaagaaatgcagaggatacatgaccagatcgtccgaatccgaggcacgaggatgtaccaaccccttacagaagatgaaatcagaatattcaaaagaaagaagaggatcaagagaagagcactcctgtttctgagttacattctaactcactttatctttctagcccttctgttgatccttatcgtcttactacgtcacactgactgcttttactataaccagtttattcgtgatcggttctctatggatcttgctactgtgactaagctggaagacatctatagatggctaaacagcgtgctgttgcctttgttacacaatgacctgaatccaacatttcttcctgaaagctcgtctaaaatccttggccttccattgatgaggcaagtgagagcaaaatctagtgaaaaaatgtgtctacctgccgaaaagtttgtgcaaaacagcatcagaagagaaattcattgtcaccccaaatatggcattgacccagaagacacaaaaaactattctggcttttggaatgaagttgataagcaggctatagatgagagtaccaatggatttacttataagcctcaaggaacgcaatggctatattattcctatggactactacacacctatggatctggaggatatgcactctatttttttccagaacagcagcggtttaattccacactgaggctcaaagaacttcaagaaagcaattggctggatgagaagacatgggctgtggttttggaattaacaacttttaatccagatataaatctgttctgtagcatttcggtcatatttgaagtctctcagttaggagttgtcaacacaagcatatctctgcactctttttcacttgctgattttgacagaaaagcttcagcagaaatctacttgtatgtggccattctcatttttttcttagcctacgttgttgatgagggttgtatcattatgcaagaaagagcctcctatgtgagaagtgtgtataatttgctcaactttgctttaaagtgcatatttactgtgttgattgtgctctttctcaggaaacatttcctggccactggcataattcggttttacttgtcgaacccagaagacttcattccctttcatgcagtttctcaggtagatcacattatgaggataattttgggtttcctgttatttctgacaattttgaagaccctcaggtattccagattcttctacgatgtgcgcctggctcagagggccatccaggctgccctccctggcatctgccacatggcatttgttgtgtccgtgtatttcttcgtatacatggcttttggttacctggtgtttggtcagcatgaatggaactacagtaacttgattcattccactcagacagtattttcctattgtgtctcagctttccagaacactgaattttccaataacaggattctgggggtcctgttcctctcatctttcatgctggtgatgatctgcgtcttgatcaacttatttcaggctgtaattctgtctgcatatgaggaaatgaagcagcccgtgtatgaggagccatcggatgaagtggaagcaatgacctatttgtgccgtaagctgagaaccatgttcagctttctgacctcgcaatctaaggccaaagatgagcctgagttctttattgacatgctgtatgggcagccagagaagaacagccaccgttatctggggctgaagaccagaaacatcaacgggaagaaaatggtttaccttgttgtttgatgaatgatggtttcatgagtcacaagcaagcgttcccccaactgctgagtctgtgggattaaggggattagggagtgtcagtggcctagtcatgctttctactcatgtccttcacaaggcacatcccctacatttggaagaatccccaatcttgtcctctgctcttgggagtgtaaaagttgggagtgtagtgtagcatctggggagacagcaggatcacagtgtgggattcctggactgatttccctttagaggggagttatgtgactccccgtacaagggcaaccctgtttctttggtgcctgcagtttagagaaggcagagccactggttttgagaaccagatttgagagagggacctggccagggtggagcattgtctgggtgtttctgcgcttgacccatgctggaagctaatggcctgttgctcctgacagagccccaaactcctcggcctcactgggaggcccctttgtagaccagggctcccctcctcttgttccccctgggcttagggcctcgtggggagttccaggacttgcttcatgcttgagaatgcagatgtggtgcttctcatttattcttaaagctactggtagttaaagtaaaattcagtaacattttctgaccaagagacatgttttgttaaacaacaaaaaggtacatatgggttcacattgaaatatgtctatatgctgaatatagcaacatatgcatctaagatttgggcatttggttattaatagcgtgctggactattcaggaataaggaaaatgtggtttatcacttaagagaaacaagggctggtagctgtactattttcactcagaagcatgttcatttatgtagatgccactttaagctttatcagaattaaatgtgagatttcttctttga

SEQ ID NO: 22945 - DNA, 14138 bp, Homo sapiens
gcactgcagcgccagcgtccgagcgggcggccgagctcccggagcggcctggccccgagccccgagcgggcgtcgctcagcagcaggtcgcggccgcagccccatccagccccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgagcaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgc

SEQ ID NO: 22946 - DNA, 12140 bp, Homo sapiens
gcactgcagcgccagcgtccgagcgggcggccgagctcccggagcggcctggccccgagccccgagcgggcgtcgctcagcagcaggtcgcggccgcagccccatccagccccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctaacggcgatggcaaaagcagatggagacgtgaaaaagtacgggagcaagcgaggggctctggccctgacccacggccactcactcctcagagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggctgggatggggtctgtggagctgaggcggccccctgcccaccaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcactgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctgagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgggcccggccctggccggcagcggcaaaggcttctcgctcaccgtgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgc

SEQ ID NO: 22947 - DNA, 14011 bp, Homo sapiens
gcactgcagcgccagcgtccgagcgggcggccgagctcccggagcggcctggccccgagccccgagcgggcgtcgctcagcagcaggtcgcggccgcagccccatccagccccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggtgtgcttgcgtagccccgggatgcccctagcccctccctgtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgc

SEQ ID NO: 22948 - DNA, 14135 bp, Homo sapiens
gcactgcagcgccagcgtccgagcgggcggccgagctcccggagcggcctggccccgagccccgagcgggcgtcgctcagcagcaggtcgcggccgcagccccatccagccccgcgcccgccatgccgtccgcgggccccgcctgagctgcggcctccgcgcgcgggcgggcctggggacggcggggccatgcgcgcgctgccctaacgatgccgcccgccgcgcccgcccgcctggcgctggccctgggcctgggcctgtggctcggggcgctggcggggggccccgggcgcggctgcgggccctgcgagcccccctgcctctgcggcccagcgcccggcgccgcctgccgcgtcaactgctcgggccgcgggctgcggacgctcggtcccgcgctgcgcatccccgcggacgccacagcgctagacgtctcccacaacctgctccgggcgctggacgttgggctcctggcgaacctctcggcgctggcagagctggatataagcaacaacaagatttctacgttagaagaaggaatatttgctaatttatttaatttaagtgaaataaacctgagtgggaacccgtttgagtgtgactgtggcctggcgtggctgccgcgatgggcggaggagcagcaggtgcgggtggtgcagcccgaggcagccacgtgtgctgggcctggctccctggctggccagcctctgcttggcatccccttgctggacagtggctgtggtgaggagtatgtcgcctgcctccctgacaacagctcaggcaccgtggcagcagtgtccttttcagctgcccacgaaggcctgcttcagccagaggcctgcagcgccttctgcttctccaccggccagggcctcgcagccctctcggagcagggctggtgcctgtgtggggcggcccagccctccagtgcctcctttgcctgcctgtccctctgctccggccccccgccacctcctgcccccacctgtaggggccccaccctcctccagcacgtcttccctgcctccccaggggccaccctggtggggccccacggacctctggcctctggccagctagcagccttccacatcgctgccccgctccctgtcactgccacacgctgggacttcggagacggctccgccgaggtggatgccgctgggccggctgcctcgcatcgctatgtgctgcctgggcgctatcacgtgacggccgtgctggccctgggggccggctcagccctgctggggacagacgtgcaggtggaagcggcacctgccgccctggagctcgtgtgcccgtcctcggtgcagagtgacgagagcctcgacctcagcatccagaaccgcggtggttcaggcctggaggccgcctacagcatcgtggccctgggcgaggagccggcccgagcggtgcacccgctctgcccctcggacacggagatcttccctggcaacgggcactgctaccgcctggtggtggagaaggcggcctggctgcaggcgcaggagcagtgtcaggcctgggccggggccgccctggcaatggtggacagtcccgccgtgcagcgcttcctggtctcccgggtcaccaggagcctagacgtgtggatcggcttctcgactgtgcagggggtggaggtgggcccagcgccgcagggcgaggccttcagcctggagagctgccagaactggctgcccggggagccacacccagccacagccgagcactgcgtccggctcgggcccaccgggtggtgtaacaccgacctgtgctcagcgccgcacagctacgtctgcgagctgcagcccggaggcccagtgcaggatgccgagaacctcctcgtgggagcgcccagtggggacctgcagggacccctgacgcctctggcacagcaggacggcctctcagccccgcacgagcccgtggaggtcatggtattcccgggcctgcgtctgagccgtgaagccttcctcaccacggccgaatttgggacccaggagctccggcggcccgcccagctgcggctgcaggtgtaccggctcctcagcacagcagggaccccggagaacggcagcgagcctgagagcaggtccccggacaacaggacccagctggcccccgcgtgcatgccagggggacgctggtgccctggagccaacatctgcttgccgctggacgcctcctgccacccccaggcctgcgccaatggctgcacgtcagggccagggctacccggggccccctatgcgctatggagagagttcctcttctccgttcccgcggggccccccgcgcagtactcggtcaccctccacggccaggatgtcctcatgctccctggtgacctcgttggcttgcagcacgacgctggccctggcgccctcctgcactgctcgccggctcccggccaccctggtccccgggccccgtacctctccgccaacgcctcgtcatggctgccccacttgccagcccagctggagggcacttgggcctgccctgcctgtgccctgcggctgcttgcagccacggaacagctcaccgtgctgctgggcttgaggcccaaccctggactgcggctgcctgggcgctatgaggtccgggcagaggtgggcaatggcgtgtccaggcacaacctctcctgcagctttgacgtggtctccccagtggctgggctgcgggtcatctaccctgccccccgcgacggccgcctctacgtgcccaccaacggctcagccttggtgctccaggtggactctggtgccaacgccacggccacggctcgctggcctgggggcagtgtcagcgcccgctttgagaatgtctgccctgccctggtggccaccttcgtgcccggctgcccctgggagaccaacgataccctgttctcagtggtagcactgccgtggctcagtgagggggagcacgtggtggacgtggtggtggaaaacagcgccagccgggccaacctcagcctgcgggtgacggcggaggagcccatctgtggcctccgcgccacgcccagccccgaggcccgtgtactgcagggagtcctagtgaggtacagccccgtggtggaggccggctcggacatggtcttccggtggaccatcaacgacaagcagtccctgaccttccagaacgtggtcttcaatgtcatttatcagagcgcggcggtcttcaagctctcactgacggcctccaaccacgtgagcaacgtcaccgtgaactacaacgtaaccgtggagcggatgaacaggatgcagggtctgcaggtctccacagtgccggccgtgctgtcccccaatgccacgctagcactgacggcgggcgtgctggtggactcggccgtggaggtggccttcctgtggacctttggggatggggagcaggccctccaccagttccagcctccgtacaacgagtccttcccggttccagacccctcggtggcccaggtgctggtggagcacaatgtcatgcacacctacgctgccccaggtgagtacctcctgaccgtgctggcatctaatgccttcgagaacctgacgcagcaggtgcctgtgagcgtgcgcgcctccctgccctccgtggctgtgggtgtgagtgacggcgtcctggtggccggccggcccgtcaccttctacccgcacccgctgccctcgcctgggggtgttctttacacgtgggacttcggggacggctcccctgtcctgacccagagccagccggctgccaaccacacctatgcctcgaggggcacctaccacgtgcgcctggaggtcaacaacacggtgagcggtgcggcggcccaggcggatgtgcgcgtctttgaggagctccgcggactcagcgtggacatgagcctggccgtggagcagggcgcccccgtggtggtcagcgccgcggtgcagacgggcgacaacatcacgtggaccttcgacatgggggacggcaccgtgctgtcgggcccggaggcaacagtggagcatgtgtacctgcgggcacagaactgcacagtgaccgtgggtgcggccagccccgccggccacctggcccggagcctgcacgtgctggtcttcgtcctggaggtgctgcgcgttgaacccgccgcctgcatccccacgcagcctgacgcgcggctcacggcctacgtcaccgggaacccggcccactacctcttcgactggaccttcggggatggctcctccaacacgaccgtgcgggggtgcccgacggtgacacacaacttcacgcggagcggcacgttccccctggcgctggtgctgtccagccgcgtgaacagggcgcattacttcaccagcatctgcgtggagccagaggtgggcaacgtcaccctgcagccagagaggcagtttgtgcagctcggggacgaggcctggctggtggcatgtgcctggcccccgttcccctaccgctacacctgggactttggcaccgaggaagccgcccccacccgtgccaggggccctgaggtgacgttcatctaccgagacccaggctcctatcttgtgacagtcaccgcgtccaacaacatctctgctgccaatgactcagccctggtggaggtgcaggagcccgtgctggtcaccagcatcaaggtcaatggctcccttgggctggagctgcagcagccgtacctgttctctgctgtgggccgtgggcgccccgccagctacctgtgggatctgggggacggtgggtggctcgagggtccggaggtcacccacgcttacaacagcacaggtgacttcaccgttagggtggccggctggaatgaggtgagccgcagcgaggcctggctcaatgtgacggtgaagcggcgcgtgcgggggctcgtcgtcaatgcaagccgcacggtggtgcccctgaatgggagcgtgagcttcagcacgtcgctggaggccggcagtgatgtgcgctattcctgggtgctctgtgaccgctgcacgcccatccctgggggtcctaccatctcttacaccttccgctccgtgggcaccttcaatatcatcgtcacggctgagaacgaggtgggctccgcccaggacagcatcttcgtctatgtcctgcagctcatagaggggctgcaggtggtgggcggtggccgctacttccccaccaaccacacggtacagctgcaggccgtggttagggatggcaccaacgtctcctacagctggactgcctggagggacaggggcccggccctggccggcagcggcaaaggcttctcgctcaccgtgctcgaggccggcacctaccatgtgcagctgcgggccaccaacatgctgggcagcgcctgggccgactgcaccatggacttcgtggagcctgtggggtggctgatggtggccgcctccccgaacccagctgccgtcaacacaagcgtcaccctcagtgccgagctggctggtggcagtggtgtcgtatacacttggtccttggaggaggggctgagctgggagacctccgagccatttaccacccatagcttccccacacccggcctgcacttggtcaccatgacggcagggaacccgctgggctcagccaacgccaccgtggaagtggatgtgcaggtgcctgtgagtggcctcagcatcagggccagcgagcccggaggcagcttcgtggcggccgggtcctctgtgcccttttgggggcagctggccacgggcaccaatgtgagctggtgctgggctgtgcccggcggcagcagcaagcgtggccctcatgtcaccatggtcttcccggatgctggcaccttctccatccggctcaatgcctccaacgcagtcagctgggtctcagccacgtacaacctcacggcggaggagcccatcgtgggcctggtgctgtgggccagcagcaaggtggtggcgcccgggcagctggtccattttcagatcctgctggctgccggctcagctgtcaccttccgcctgcaggtcggcggggccaaccccgaggtgctccccgggccccgtttctcccacagcttcccccgcgtcggagaccacgtggtgagcgtgcggggcaaaaaccacgtgagctgggcccaggcgcaggtgcgcatcgtggtgctggaggccgtgagtgggctgcaggtgcccaactgctgcgagcctggcatcgccacgggcactgagaggaacttcacagcccgcgtgcagcgcggctctcgggtcgcctacgcctggtacttctcgctgcagaaggtccagggcgactcgctggtcatcctgtcgggccgcgacgtcacctacacgcccgtggccgcggggctgttggagatccaggtgcgcgccttcaacgccctgggcagtgagaaccgcacgctggtgctggaggttcaggacgccgtccagtatgtggccctgcagagcggcccctgcttcaccaaccgctcggcgcagtttgaggccgccaccagccccagcccccggcgtgtggcctaccactgggactttggggatgggtcgccagggcaggacacagatgagcccagggccgagcactcctacctgaggcctggggactaccgcgtgcaggtgaacgcctccaacctggtgagcttcttcgtggcgcaggccacggtgaccgtccaggtgctggcctgccgggagccggaggtggacgtggtcctgcccctgcaggtgctgatgcggcgatcacagcgcaactacttggaggcccacgttgacctgcgcgactgcgtcacctaccagactgagtaccgctgggaggtgtatcgcaccgccagctgccagcggccggggcgcccagcgcgtgtggccctgcccggcgtggacgtgagccggcctcggctggtgctgccgcggctggcgctgcctgtggggcactactgctttgtgtttgtcgtgtcatttggggacacgccactgacacagagcatccaggccaatgtgacggtggcccccgagcgcctggtgcccatcattgagggtggctcataccgcgtgtggtcagacacacgggacctggtgctggatgggagcgagtcctacgaccccaacctggaggacggcgaccagacgccgctcagtttccactgggcctgtgtggcttcgacacagagggaggctggcgggtgtgcgctgaactttgggccccgcgggagcagcacggtcaccattccacgggagcggctggcggctggcgtggagtacaccttcagcctgaccgtgtggaaggccggccgcaaggaggaggccaccaaccagacggtgctgatccggagtggccgggtgcccattgtgtccttggagtgtgtgtcctgcaaggcacaggccgtgtacgaagtgagccgcagctcctacgtgtacttggagggccgctgcctcaattgcagcagcggctccaagcgagggcggtgggctgcacgtacgttcagcaacaagacgctggtgctggatgagaccaccacatccacgggcagtgcaggcatgcgactggtgctgcggcggggcgtgctgcgggacggcgagggatacaccttcacgctcacggtgctgggccgctctggcgaggaggagggctgcgcctccatccgcctgtcccccaaccgcccgccgctggggggctcttgccgcctcttcccactgggcgctgtgcacgccctcaccaccaaggtgcacttcgaatgcacgggctggcatgacgcggaggatgctggcgccccgctggtgtacgccctgctgctgcggcgctgtcgccagggccactgcgaggagttctgtgtctacaagggcagcctctccagctacggagccgtgctgcccccgggtttcaggccacacttcgaggtgggcctggccgtggtggtgcaggaccagctgggagccgctgtggtcgccctcaacaggtctttggccatcaccctcccagagcccaacggcagcgcaacggggctcacagtctggctgcacgggctcaccgctagtgtgctcccagggctgctgcggcaggccgatccccagcacgtcatcgagtactcgttggccctggtcaccgtgctgaacgagtacgagcgggccctggacgtggcggcagagcccaagcacgagcggcagcaccgagcccagatacgcaagaacatcacggagactctggtgtccctgagggtccacactgtggatgacatccagcagatcgctgctgcgctggcccagtgcatggggcccagcagggagctcgtatgccgctcgtgcctgaagcagacgctgcacaagctggaggccatgatgctcatcctgcaggcagagaccaccgcgggcaccgtgacgcccaccgccatcggagacagcatcctcaacatcacaggagacctcatccacctggccagctcggacgtgcgggcaccacagccctcagagctgggagccgagtcaccatctcggatggtggcgtcccaggcctacaacctgacctctgccctcatgcgcatcctcatgcgctcccgcgtgctcaacgaggagcccctgacgctggcgggcgaggagatcgtggcccagggcaagcgctcggacccgcggagcctgctgtgctatggcggcgccccagggcctggctgccacttctccatccccgaggctttcagcggggccctggccaacctcagtgacgtggtgcagctcatctttctggtggactccaatccctttccctttggctatatcagcaactacaccgtctccaccaaggtggcctcgatggcattccagacacaggccggcgcccagatccccatcgagcggctggcctcagagcgcgccatcaccgtgaaggtgcccaacaactcggactgggctgcccggggccaccgcagctccgccaactccgccaactccgttgtggtccagccccaggcctccgtcggtgctgtggtcaccctggacagcagcaaccctgcggccgggctgcatctgcagctcaactatacgctgctggacggccactacctgtctgaggaacctgagccctacctggcagtctacctacactcggagccccggcccaatgagcacaactgctcggctagcaggaggatccgcccagagtcactccagggtgctgaccaccggccctacaccttcttcatttccccggggagcagagacccagcggggagttaccatctgaacctctccagccacttccgctggtcggcgctgcaggtgtccgtgggcctgtacacgtccctgtgccagtacttcagcgaggaggacatggtgtggcggacagaggggctgctgcccctggaggagacctcgccccgccaggccgtctgcctcacccgccacctcaccgccttcggcgccagcctcttcgtgcccccaagccatgtccgctttgtgtttcctgagccgacagcggatgtaaactacatcgtcatgctgacatgtgctgtgtgcctggtgacctacatggtcatggccgccatcctgcacaagctggaccagttggatgccagccggggccgcgccatccctttctgtgggcagcggggccgcttcaagtacgagatcctcgtcaagacaggctggggccggggctcaggtaccacggcccacgtgggcatcatgctgtatggggtggacagccggagcggccaccggcacctggacggcgacagagccttccaccgcaacagcctggacatcttccggatcgccaccccgcacagcctgggtagcgtgtggaagatccgagtgtggcacgacaacaaagggctcagccctgcctggttcctgcagcacgtcatcgtcagggacctgcagacggcacgcagcgccttcttcctggtcaatgactggctttcggtggagacggaggccaacgggggcctggtggagaaggaggtgctggccgcgagcgacgcagcccttttgcgcttccggcgcctgctggtggctgagctgcagcgtggcttctttgacaagcacatctggctctccatatgggaccggccgcctcgtagccgtttcactcgcatccagagggccacctgctgcgttctcctcatctgcctcttcctgggcgccaacgccgtgtggtacggggctgttggcgactctgcctacagcacggggcatgtgtccaggctgagcccgctgagcgtcgacacagtcgctgttggcctggtgtccagcgtggttgtctatcccgtctacctggccatcctttttctcttccggatgtcccggagcaaggtggctgggagcccgagccccacacctgccgggcagcaggtgctggacatcgacagctgcctggactcgtccgtgctggacagctccttcctcacgttctcaggcctccacgctgaggcctttgttggacagatgaagagtgacttgtttctggatgattctaagagtctggtgtgctggccctccggcgagggaacgctcagttggccggacctgctcagtgacccgtccattgtgggtagcaatctgcggcagctggcacggggccaggcgggccatgggctgggcccagaggaggacggcttctccctggccagcccctactcgcctgccaaatccttctcagcatcagatgaagacctgatccagcaggtccttgccgagggggtcagcagcccagcccctacccaagacacccacatggaaacggacctgctcagcagcctgtccagcactcctggggagaagacagagacgctggcgctgcagaggctgggggagctggggccacccagcccaggcctgaactgggaacagccccaggcagcgaggctgtccaggacaggactggtggagggtctgcggaagcgcctgctgccggcctggtgtgcctccctggcccacgggctcagcctgctcctggtggctgtggctgtggctgtctcagggtgggtgggtgcgagcttccccccgggcgtgagtgttgcgtggctcctgtccagcagcgccagcttcctggcctcattcctcggctgggagccactgaaggtcttgctggaagccctgtacttctcactggtggccaagcggctgcacccggatgaagatgacaccctggtagagagcccggctgtgacgcctgtgagcgcacgtgtgccccgcgtacggccaccccacggctttgcactcttcctggccaaggaagaagcccgcaaggtcaagaggctacatggcatgctgcggagcctcctggtgtacatgctttttctgctggtgaccctgctggccagctatggggatgcctcatgccatgggcacgcctaccgtctgcaaagcgccatcaagcaggagctgcacagccgggccttcctggccatcacgcggtctgaggagctctggccatggatggcccacgtgctgctgccctacgtccacgggaaccagtccagcccagagctggggcccccacggctgcggcaggtgcggctgcaggaagcactctacccagaccctcccggccccagggtccacacgtgctcggccgcaggaggcttcagcaccagcgattacgacgttggctgggagagtcctcacaatggctcggggacgtgggcctattcagcgccggatctgctgggggcatggtcctggggctcctgtgccgtgtatgacagcgggggctacgtgcaggagctgggcctgagcctggaggagagccgcgaccggctgcgcttcctgcagctgcacaactggctggacaacaggagccgcgctgtgttcctggagctcacgcgctacagcccggccgtggggctgcacgccgccgtcacgctgcgcctcgagttcccggcggccggccgcgccctggccgccctcagcgtccgcccctttgcgctgcgccgcctcagcgcgggcctctcgctgcctctgctcacctcggtgtgcctgctgctgttcgccgtgcacttcgccgtggccgaggcccgtacttggcacagggaagggcgctggcgcgtgctgcggctcggagcctgggcgcggtggctgctggtggcgctgacggcggccacggcactggtacgcctcgcccagctgggtgccgctgaccgccagtggacccgtttcgtgcgcggccgcccgcgccgcttcactagcttcgaccaggtggcgcagctgagctccgcagcccgtggcctggcggcctcgctgctcttcctgcttttggtcaaggctgcccagcagctacgcttcgtgcgccagtggtccgtctttggcaagacattatgccgagctctgccagagctcctgggggtcaccttgggcctggtggtgctcggggtagcctacgcccagctggccatcctgctcgtgtcttcctgtgtggactccctctggagcgtggcccaggccctgttggtgctgtgccctgggactgggctctctaccctgtgtcctgccgagtcctggcacctgtcacccctgctgtgtgtggggctctgggcactgcggctgtggggcgccctacggctgggggctgttattctccgctggcgctaccacgccttgcgtggagagctgtaccggccggcctgggagccccaggactacgagatggtggagttgttcctgcgcaggctgcgcctctggatgggcctcagcaaggtcaaggagttccgccacaaagtccgctttgaagggatggagccgctgccctctcgctcctccaggggctccaaggtatccccggatgtgcccccacccagcgctggctccgatgcctcgcacccctccacctcctccagccagctggatgggctgagcgtgagcctgggccggctggggacaaggtgtgagcctgagccctcccgcctccaagccgtgttcgaggccctgctcacccagtttgaccgactcaaccaggccacagaggacgtctaccagctggagcagcagctgcacagcctgcaaggccgcaggagcagccgggcgcccgccggatcttcccgtggcccatccccgggcctgcggccagcactgcccagccgccttgcccgggccagtcggggtgtggacctggccactggccccagcaggacaccccttcgggccaagaacaaggtccaccccagcagcacttagtcctccttcctggcgggggtgggccgtggagtcggagtggacaccgctcagtattactttctgccgctgtcaaggccgagggccaggcagaatggctgcacgtaggttccccagagagcaggcaggggcatctgtctgtctgtgggcttcagcactttaaagaggctgtgtggccaaccaggacccagggtcccctccccagctcccttgggaaggacacagcagtattggacggtttctagcctctgagatgctaatttatttccccgagtcctcaggtacagcgggctgtgcccggccccaccccctgggcagatgtcccccactgctaaggctgctggcttcagggagggttagcctgcaccgccgccaccctgcccctaagttattacctctccagttcctaccgtactccctgcaccgtctcactgtgtgtctcgtgtcagtaatttatatggtgttaaaatgtgtatatttttgtatgtcactattttcactagggctgaggggcctgcgcccagagctggcctcccccaacacctgctgcgcttggtaggtgtggtggcgttatggcagcccggctgctgcttggatgcgagcttggccttgggccggtgctgggggcacagctgtctgccaggcactctcatcaccccagaggccttgtcatcctcccttgccccaggccaggtagcaagagagcagcgcccaggcctgctggcatcaggtctgggcaagtagcaggactaggcatgtcagaggaccccagggtggttagaggaaaagactcctcctgggggctggctcccagggtggaggaaggtgactgtgtgtgtgtgtgtgtgcgcgcgcgcacgcgcgagtgtgctgtatggcccaggcagcctcaaggccctcggagctggctgtgcctgcttctgtgtaccacttctgtgggcatggccgcttctagagcctcgacacccccccaacccccgcaccaagcagacaaagtcaataaaagagctgtctgactgc

SEQ ID NO: 22949 - DNA, 9092 bp, Homo sapiens
ggaagaagctggtctgctgactgtcatacttgtgaccagcttgcacaggacatggccgaggaggcagcccagaacatttctgatgaccaggaaaggtgtctccaggctgcctgctgcctttcctttggtggtgagctgtctgtgagcactgacaagagctggggtcttcatctgtgcagctgtagccctcctggaggtggattgtgggtcgaggtctatgctaatcatgtgcttcttatgagtgatgggaagtgtggctgtccttggtgtgctctgaatggaaaggcagaagaccgggaatcacagagcccatcctcatcagcttccaggcagaagaacatttggaaaacaactagtgaagcagcgttaagtgttgttaatgaaaaaacacaggctgttgttaatgaaaaaacacaggcgcctctggattgtgataacagtgctgatagaattccccacaaacctttcattataatcgcaagggcctggagcagtggtggccccaggttccatcacaggcggctgtgtgctactgggaccgcagacagcacattctctgctcttctccagctccagggcaccacttctgcagcagctccctgcagcctgaagatggaggcttcctgctgtgtcctgagactgctgtgctgtgcggaggatgtggccacggggctgcttcctgggactgtcacgatggagacccccaccaaggtggccagacccactcagaccagctcccagcgagtgcccctgtggccgatttcacattttcccacttctcccagaagctcccacggccttccgcctggcattcctcgcacccccagcttcacggcatcgcagtctggttctgagatcctctatccccctactcagcatcctcctgtggccatcctagctcgaaattctgataacttcatgaaccctgttcttaattgctccctggaagtggaagctcgggcacctccaaatctgggattccgtgttcatatggcttctggagaggctctctgtctgatgatggatttcggggacagttctggggttgaaatgaggctacacaacatgtctgaggcaatggcggtgactgcctaccaccagtactcaaaaggtattttttttcatcttttacattttcagttggatatgtccacctacaaagaagcagagacacaaaatacaactttaaatgtttacttgtgccaaagtgaaaacagctgcctggaagactcagaccccagtaaccttggatatgagcttatttctgcctttgtcaccaaaggagtctatatgctcaaggctgttatttataacgagtttcatggaaccgaagtggagcttgggccttattatgtggagattggccatgaggccgtgtctgcgttcatgaactccagcagtgtccatgaagatgaagtgcttgtctttgctgactcccaagtgaatcagaaaagcactgtggttatacatcactttccatctattccttcatataacgtgtcctttatttctcagactcaagtgggtgacagccaggcttggcacagcatgactgtctggtataagatgcaatccgtctctgtctacacaaatggaactgtgtttgccacagacacagacattacatttacagctgttaccaaggaaacaatacccctggaatttgagtggtattttggagaggatccaccagtgaggacaacttcaagaagcattaaaaaaagactcagcatcccccaatggtatcgtgtgatggttaaggcttccaacaggatgagcagtgtggtctctgagccccatgtcatcagggtgcagaagaaaattgtggccaatcggctcacgtccccctcctcagctctggtaaatgccagtgtggcctttgagtgctggatcaacttcggcacagatgttgcctacctgtgggactttggggatggcaccgtcagcctggggagcagctccagcagccatgtctacagtagggaaggagaatttacagtggaggtccttgccttcaataatgtcagtgcctccactctaagacagcaacttttcatcgtgtgcgagccctgccagccacccctggtgaagaacatggggcctgggaaagtccagatatggaggtctcagcctgtgaggctgggagtgacgtttgaagctgcagtcttctgtgatatttcccaaggtctttcttacacctggaacttgatggactctgaagggctccctgtctccctccctgctgctgtggacactcacagacagaccctcatcctcccgagccacaccttggagtatgggaactacactgcccttgccaaggttcagattgaaggcagtgtggtgtacagcaactactgtgtgggcctggaggtgcgagcccaggcccctgtcagtgtgatctccgagggcacacacctattcttctccaggaccacctcatcccccattgtcctcagagggacccagtccttcgaccctgacgaccctggggcgactctcaggtatcactgggaatgcgccaccgctggctccccagcacatccctgcttcgactcctccactgcacaccaactggatgccgcggctcccactgtttcctttgaggcacaatggctcagtgacagctatgatcagttccttgtgatgctgagggtctccagtggtggccggaactcttctgagacccgggtgttcctgtccccctaccctgactcggcgttcagattcgtccacatctcctgggtcagctttaaagacaccttcgtcaactggaatgacgaactctctcttcaagctatgtgtgaggactgcagtgaaataccgaatctgtcttattcctgggatctctttttagtcaatgcaacagaaaagaataggatagaagttcccttctgcagagtagtggggctgcttggctcgctgggactcggtgccatttcagagtcatcacagttaaacctgctgcccactgagcctggcactgcagatcctgatgcaacgaccacaccattctcacgggaaccttcacccgtgacccttggccaacctgccacttcagctccaaggggaacccccacagagcccatgactggagtctactggattcctcctgcgggggactctgcagtcctgggggaggctccagaggaaggttcactagacctagagccagggccacagagcaagggatccctgatgactggccgctctgagagaagtcagcccacccacagccctgaccctcacctctctgattttgaagcctattacagtgacattcaagaagcaataccatcgggaggaagacagccagctaaggacaccagctttccaggatcaggacctagcttgagtgccgaggagagccctggagatggggataacctggtggacccctccctgtctgcaggcagagccgagcctgtcctcatgattgactggcccaaggccctgctgggtcgagcagttttccaaggctattcatcctcaggtattacagaacagacagtgacaatcaagccatactctctgagcagtggagagacgtacgtcctgcaagtgtctgtggcttcgaagcatggcttactgggtaaagctcagctgtacttgacagtcaacccggctcctcgggacatggcctgtcaggtgcagccccaccatggtctggaagcacacaccgtcttcagtgtcttctgcatgtctggaaaaccggacttccattatgaatttagttaccagataggaaacacctccaaacacactttgtaccatgggagagacacccagtattattttgtgttgccagctggtgagcacttggacaattacaaagtcatggtttccactgaaatcacagatggcaaaggctccaaggtccagccgtgcactgtggtggtgactgtgctgccccgctaccatggaaatgactgtctgggcgaggacctgtataattccagcctgaaaaacctttctaccctccagctgatggggagttacacagaaatcaggaactacatcactgtgatcaccagaatcctgagtcgtttgtctaaggaggacaaaactgcctcctgcaaccaatggtcacgaatacaggatgcattaatttcttcagtatgcagattggcttttgtagatcaggaagaaatgattggttctgttcttatgttgagggacctcgtgagcttctctaataagctaggctttatgagtgcggttctcatcctcaagtacacccgggcactccttgctcaaggccagttctcggggccatttgtgattgacaaaggagtgaggcttgagctcatcggtctcatatccagagtctgggaagtctctgagcaagaaaactcgaaggaggaagtctatcgacatgaagaaggaattacagtcatctcagatttattgttgggttgtctctctttgaaccatgttagcactgggcagatggagttccggacccttcttcattacaaccttcagagctctgtccagagcctgggatctgtccaggtgcatttacctggtgaccttgctgggcacagtcctgctggggcggagacacagagcccatgctacattagccagctcatactcttcaagaagaacccatatccagggagccaagctcctgggcagattggtggagttgtgggcctcaacctctatacctgctccagcagaagacccatcaacaggcaatggctaaggaaacccgtgatggtcgagtttggggaggaggatggcctggataataggagaaataaaacgacatttgtattacttcgggataaagtgaatctccatcagttcactgagctttccgaaaacccccaggaatctctacagatagaaattgaattttccaaacctgttacaagggcatttcccgtcatgttgctagtaagattctctgagaaacctactccctctgattttcttgtgaagcagatctacttctgggatgagtcaattgtgcagatttatatacctgctgcttctcagaaagatgccagtgtaggctatttatccttattggatgctgactatgacagaaaacctccaaacagatatttagctaaggcagtgaactatacagtacatttccagtggatccgatgcctgttttgggacaagagagagtggaaatctgaacgtttctctccacaaccagggacttctcctgaaaaagtgaactgcagctaccatcgcctcgcggcattcgctctcctaaggagaaagctgaaggccagttttgaagtgagtgacatttccaagctacagagccacccagaaaacttgcttcccagtatttttattatgggttctgtgattctttatggatttttggtcgctaaaagtagacaagtagatcatcatgaaaaaaagaaagctggttacatctttctgcaagaagcttccctgccgggccatcagctatatgcggtcgtcattgacactggcttccgagctccggccaggttgacctcaaaggtgtacattgttttatgtggcgacaatggactgtcagaaaccaaggagctctcctgtccagagaagcccctgtttgaaaggaattccagacacacctttatcctgagcgctcctgcccaactgggcctgctgaggaagatccgcctctggcacgacagccgtgggccttccccaggctggttcatcagccacgtgatggtgaaggagctgcacacgggacagggctggttcttccctgcccagtgctggctgtctgccggcaggcatgatggtcgcgtggagcgggagctcacctgtctgcaagggggactcggcttccggaagcttttctattgcaagttcacagagtacctggaggatttccatgtctggctgtcggtgtacagcaggccctcctccagccgctacctgcacacgccgcgcctcaccgtgtccttctccctgctgtgcgtctacgcgtgtctcactgccctggttgctgctggagggcaagagcagccccacttggacgtcagccccacccttggatccttcagggtgggtctcctgtgtaccctcctggcttctccaggggcccagctcttgtccctgctcttcaggctcagcaaggaagccccggggtctgcccgagtggagccacacagcccacttagaggaggagcacagaccgaggcaccccatggtcctaattcctggggaaggataccagacgcacaggagccacgcaagcaacctgcatcagccattctctctgggagtggcagggcccaaaggaaggcggcaagtgacaatggcacagcttgtccagcccctaagctgcaggttcatggggctgaccacagcaggacttctctgatggggaaaagccactgctgccctccccacactcaagcacccagcagtggtttggagggactaatgccccagtggtcaagggcccttcagccttggtggagctctgcagtgtgggccatttgtgggaccgcttctttggcctgcagtttggggacaggatttctagcctacaggtttggccaggagcaatgtgtgcagtggctgcacctgctgtccctctccgtggtctgctgtattttcatcacccagccacttatggtatgcctcatggccttgggttttgcttggaaaagaagagctgacaaccacttttttactgagtctttatgtgaggctaccagggatctggactctgaattggcagaacgttcctggactcgcctccccttctcttcaagctgcagtattcctgactgtgcaggcgaggttgaaaaagtcttggctgcccgacaacaagctcgccacctgcgctgggcgcatccaccatccaaggcccagctgaggggcaccagacagaggatgaggagagagagtcgcacacgggctgccctgagagacatttccatggacatcctcatgctgcttctgcttttgtgtgtaatatatgggagattttcccaagatgaatactccctcaatcaagctatccggaaagaatttacaagaaatgccagaaactgcttgggtggcctgagaaacatcgctgactggtgggactggagtctgaccacacttctggatggcctgtacccgggaggcaccccgtcagcccgtgtgccgggggctcagcctggagctcttggaggaaaatgctacctaataggcagttccgtaattaggcagctaaaagtttttcctaggcatttatgcaagcctcccaggccattttcagcactcatcgaagactctattcctacatgtagtcccgaagttggaggccctgagaacccctacctgatagacccagagaaccaaaacgtgaccctgaatggtcctgggggctgtgggacaagggaggactgtgtgctcagcctgggcagaacaaggactgaagcccacacagccctgtcccgactcagggccagcatgtggattgaccgcagcaccagggctgtgtctgtgcacttcactctctataaccctccaacccaactcttcaccagcgtgtccctgagagtggagatcctccctacggggagtctcgtcccctcatccctggtggagtcattcagcatcttccgcagcgactcagccctgcagtaccacctcatgcttccccagctggtcttcctggcactcagcctgatccacctctgtgttcaactctaccgtatgatggacaagggcgtcctcagctactggcgaaagccaaggaactggctggagctctccgtggttggagtgagcctcacctactatgcagtttccggccaccttgttactcttgctggagatgtcactaaccagtttcacagaggactttgccgagcatttatggacctcacccttatggcatcatggaatcagagggctcgatggctccggggaatcctcttattcctcttcacattaaaatgcgtctatcttcctggcattcaaaacacaatggcatcctgctcctccatgatgcgccactcactccccagcatctttgtagcagggctggtgggggcactgatgctggccgccctctcccacctgcaccgatttctgctctctatgtgggttctaccacctggcaccttcacagacgccttccccgggctgctgtttcattttcccagaagaagccaaaaagactgcctccttggcctttccaagtctgaccagcgggccatggcttgttactttgggatccttttaatagtctctgccacactgtgttttggaatgctgagaggttttctcatgactttaccccaaaaaagaaaatcttttcaaagtaaatcttttgtgagacttaaagatgtcactgcttatatgtgggaaaaggtcctcacctttctgagactggaaacaccaaagttggaagaggctgagatggttgagaatcacaattactacttggatgaatttgcaaatctgttagacgaacttctgatgaagattaatggtttgtccgacagcctacaactcccccttctggaaaaaacatccaacaacacaggggaggcaaggacagaagagagtcccttagtggacatttctagttaccaagctgctgagccagcagacatcaaggacttctgaggagcctggtaccttgcataggcactatggaccctgttttgcttaacccacccaacagccaattttagcagacatcctagttttgcaggtgagaagagctgaggtacgaagaagttttgttaatttttccagttcacgtaacaagtaaatgggaaaccaggatgaaaatcaaggtttatctgtcatcagactgttactcataatcaccattcggagagttcagatgtgggacaagattctaactccagccttctcccaaatggttaatttgccagttgccctagagttacatattgtcttatttgtttgttttactgaatctgtctgagtattaaaagccttgtatcttgtgaaatttctttcaggtctcataaaagcgatgaaagagaccaggataacattctaatatttaaataagatttttgaagtaaaatccttattttgtaaatttaacaattgaatcttgctagattaataacgcatctttcctg

SEQ ID NO: 22950 - DNA, 520 bp, Homo sapiens
agttggaggccctgagaacccctacctgatagacccagagaaccaaaacgtgaccctgaatggtcctgggggctgtgggacaagggaggactgtgtgctcagcctgggcagaacaaggactgaagcccacacagccctgtcccgactcagggccagcatgtggattgaccgcagcaccagggctgtgtctgtgcacttcactctctataaccctccaacccaactcttcaccagcgtgtccctgagagtggagatcctccctacggggagtctcgtcccctcatccctggtggagtcattcagcatcttccgcagcgactcagccctgcagtaccacctcatgcttccccagctggtcttcctggcactcagcctgatccacctctgtgttcaactctaccgtatgatggacaagggcgtcctcagctactggcgaaagccaaggaactggctggaggtagcctctcttgtgtcattttcttttgaaaaataacaataaactgtttatatcttgaaaaaa

SEQ ID NO: 22951 - DNA, 5056 bp, Homo sapiens
ggctcctgaggcgcacagcgccgagcgcggcgccgcgcacccgcgcgccggacgccagtgaccgcgatggtgaactccagtcgcgtgcagcctcagcagcccggggacgccaagcggccgcccgcgccccgcgcgccggacccgggccggctgatggctggctgcgcggccgtgggcgccagcctcgccgccccgggcggcctctgcgagcagcggggcctggagatcgagatgcagcgcatccggcaggcggccgcgcgggaccccccggccggagccgcggcctccccttctcctccgctctcgtcgtgctcccggcaggcgtggagccgcgataaccccggcttcgaggccgaggaggaggaggaggaggtggaaggggaagaaggcggaatggtggtggagatggacgtagagtggcgcccgggcagccggaggtcggccgcctcctcggccgtgagctccgtgggcgcgcggagccgggggcttgggggctaccacggcgcgggccacccgagcgggaggcggcgccggcgagaggaccagggcccgccgtgccccagcccagtcggcggcggggacccgctgcatcgccacctccccctggaagggcagccgccccgagtggcctgggcggagaggctggttcgcgggctgcgaggtctctggggaacaagactcatggaggaaagcagcactaaccgagagaaataccttaaaagtgttttacgggaactggtcacatacctcctttttctcatagtcttgtgcatcttgacctacggcatgatgagctccaatgtgtactactacacccggatgatgtcacagctcttcctagacacccccgtgtccaaaacggagaaaactaactttaaaactctgtcttccatggaagacttctggaagttcacagaaggctccttattggatgggctgtactggaagatgcagcccagcaaccagactgaagctgacaaccgaagtttcatcttctatgagaacctgctgttaggggttccacgaatacggcaactccgagtcagaaatggatcctgctctatcccccaggacttgagagatgaaattaaagagtgctatgatgtctactctgtcagtagtgaagatagggctccctttgggccccgaaatggaaccgcttggatctacacaagtgaaaaagacttgaatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcaggttattggttgaattcccagcaacaggtggtgtgattccatcttggcaatttcagcctttaaagctgatccgatatgtcacaacttttgatttcttcctggcagcctgtgagattatcttttgtttctttatcttttactatgtggtggaagagatattggaaattcgcattcacaaactacactatttcaggagtttctggaattgtctggatgttgtgatcgttgtgctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttacccatggttcaaagatttttttttctttttctcatataagaaatctaggtgtaaatattgagtacagaaaaaaaatcttcatgatgtgtattgagcggtacgcccagttgccaccatgactgagtcttctcagttgacaatgaagtagccttttaaagctagaaaactgtcaaagggcttctgagtttcatttccagtcacaaaaatcagtattgttatttttttccaagagtgtgaaggaaaatggggcattcctttccactctggcatagttcatgagcttaatacatagctttcttttaagaaaggagccttttttttcaactagcttcctggggtaaacttttctaaaagataaaatggaaaggaactccaaactatgatagaatctgtgtgaatggttaagatgaatgttaaatactatgcttttttgtaagttgatcgtatctgatgtctgtgggactaactgtatcacttaatttttaccttattttggctctaatttgaataagctgagtaaaaccaccaaagatcagttataggataaaatggcatctctaaccataacacaggagaattggaaggagccctaagttgtcactcagtttaatttcttttaatggttagtttagcctaaagatttatctgcatattctttttcccatgtggctctactcatttgcaactgaatttaatgttataactcatctagtgagaccaacttactaaatttttagtatgcactgaaagtttttatccaacaattatgttcattttaagcaaaattttaagaaagttttgaaattcataaagcatttggttttaaactattttaagaatatagtactcggtcaggtatgacggctcacgcctgtaatcccagcactttgggaggccgaaacaggcgaatcacttgagcccaggagttcaagaccaacatgggcaatgtggcgaaactccatctctacaaaaaatgcaaaaataaaaaatatagtactcaagtattcttgatcctgtgtttcaaaactagaatttgtaatgcaaatggagctcagtctaataaaaaagaggttttggtattaaaagttcatacattagacagtatcagccaaaatttgagttagcaacactgttttctttacgagagggtctcacccaaatttatggggagaaatctatttctcaaaaaaaaaaatcttcttttacagaaatgttgagtaaggtgacattttgagcgctaataagcaaaagagcatgcagtgctgttgaataaccctcacttggagaaccaagagaatcctgtcgtttaatgctatattttaatttcacaagttgttcatttaactggtagaatgtcagtccaatctccaatgagaacatgagcaaatagacctttccaggttgaaagtgaaacatactgggtttctgtaagtttttcctcatggcttcatctctatctttactttctcttgaatatgctacacaaagttctttattactacatactaaagtttgcattccagggatattgactgtacatatttatgtatatgtaccatgttgttacatgtaaacaaacttcaatttgaagtgcagctattatgtggtatccatgtgtatcgaccatgtgccatatatcaattatggtcactagaaagtctctttatgatactttttattgtactgtttttcatttcacttgcaaaattttgcagaattcctcctttctacccataaattacatatatttttcttctttagtcatggagaactccccccctcatctcttccctattatctttccctgtgtactggtattattaaaaagacattacatacgcaagtctttctcgacaatcaagaatgttattaatgtgtaatactgagcactttacttcttaataaaaacttgatatagtagca

SEQ ID NO: 22952 - DNA, 1222 bp, Homo sapiens
atgtcttctctctcttacagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgttt

SEQ ID NO: 22953 - DNA, 1720 bp, Homo sapiens
aatggtagtagccactggggaatcattgcaacttatagtggagctggctattatctggatttgtcaagaacaagagaggaaacagctgcacaagttgctagcctcaagaaaaatgtctggctggaccgaggaaccagggcaacttttattgacttctcagtgtacaacgccaacattaacctgttctgtgtggtcagctgtcagtggtagctataggaattaacatatacagaacatcaaatgtggaggtgctactacagtttctggaagatcaaaatactttccccaactttgagcatctggcatattggcagatacagttcaacaatatagctgctgtcacagtattttttgtctggattaagctcttcaaattcatcaattttaacaggaccatgagccagctctcgacaaccatgtctcgatgtgccaaagacctgtttggctttgctattatgttcttcattattttcctagcgtatgctcagttggcataccttgtctttggcactcaggtcgatgacttcagtactttccaagagtgtatcttcactcaattccgtatcattttgggcgatatcaactttgcagagattgaggaagctaatcgagttttgggaccaatttatttcactacatttgtgttctttatgttcttcattcttttgaatatgtttttggctatcatcaatgatacttactctgaagtgaaatctgacttggcacagcagaaagctgaaatggaactctcagatcttatcagaaagggctaccataaagctttggtcaaactaaaactgaaaaaaaataccgtggatgacatttcagagagtctgcggcaaggaggaggcaagttaaactttgacgaacttcgacaagatctcaaagggaagggccatactgatgcagagattgaggcaatattcacaaagtacgaccaagatggagaccaagaactgaccgaacatgaacatcagcagatgagagacgacttggagaaagagagggaggacctggatttggatcacagttctttaccacgtcccatgagcagccgaagtttccctcgaagcctggatgactctgaggaggatgacgatgaagatagcggacatagctccagaaggaggggaagcatttctagtggcgtttcttacgaagagtttcaagtcctggtgagacgagtggaccggatggagcattccatcggcagcatagtgtccaagattgacgccgtgatcgtgaagctagagattatggagcgagccaaactgaagaggagggaggtgctgggaaggctgttggatggggtggccgaggatgaaaggctgggtcgtgacagtgaaatccatagggaacagatggaacggctagtacgtgaagagttggaacgctgggaatccgatgatgcagcttcccagatcagtcatggtttaggcacgccagtgggactaaatggtcaacctcgccccagaagctcccgcccatcttcctcccaatctacagaaggcatggaaggtgcaggtggaaatgggagttctaatgtccacgtatgatatgtgtgtttcagtatgtgtgtttctaataagtgaggaagtggctgtcctgaattgctgtaacaagcacactatttatatgccctgaccaccataggatgctagtctttgtgaccgattgctaatcttctgcactttaatttattttatataaactttaccca

SEQ ID NO: 22954 - DNA, 3043 bp, Homo sapiens
cagcatcgccttttcctcccgtttctccttccactcccagctccacatcctcctcctattctcccctctcccctcttcaaacccccaccttccagttccctcacctcccctttcggctggtcccctggggcttgcagcaagagggagagagagctcctgacaggattgatggtccttccccaccctgtcctctcatccgctccctccccagcaggcacagacatccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggtgtccagctgctgcctccatatctgtcaaggcatcagaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactggagtctcctttcaggccatcagcagcatggcggacttctgggattttgcccagggcccactactggacagtttgtattggaccaaatggtacaacaaccagagcctgggccatggctcccactccttcatctactatgagaacatgctgctgggggttccgaggctgcggcagctaaaggtccgcaatgactcctgtgtggtgcatgaagacttccgggaggacattctgagctgctatgatgtctactctccagacaaagaagaacaactcccctttgggcccttcaatggcacagcgtggacataccactcgcaggatgagttggggggcttctcccactggggcaggctcacaagctacagcggaggtggctactacctggaccttccaggatcccgacagggtagtgcagaggctctccgggcccttcaggaggggctgtggctggacaggggcactcgagtggtgttcatcgacttctcagtctacaatgccaatatcaatcttttctgtgtcctgaggctggtggtggagtttccagctacaggaggtgccatcccatcctggcaaatccgcacagtcaagctgatccgctatgtcagcaactgggacttctttatcgttggctgtgaggtcatcttctgcgtcttcatcttctactatgtggtggaagagatcctggagctccacattcaccggcttcgctacctcagcagcatctggaacatactggacctggtggtcatcttgctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaagatattcaagtacatcagcttcaacaaaaccatgacccagctctcctccacgctggcccgctgtgccaaggacatcctgggcttcgccgtcatgttcttcattgttttcttcgcctatgcccaactcggctacctgcttttcgggacccaagtggaaaactttagcactttcatcaagtgcattttcactcagttccggataatcctcggggactttgactacaatgctatcgacaatgccaaccgcatcctgggccctgcctactttgtcacctatgtcttcttcgtcttcttcgtgctcctgaacatgttcctggccatcatcaatgacacatattcagaggtcaaggaggagctggctggacagaaggatgagctgcaactttctgacctcctgaaacagggctacaacaagaccctactaagactgcgtctgaggaaggagagggtttcggatgtgcagaaggtcctgcagggtggggagcaggagatccagtttgaggatttcaccaacaccttaagggaactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaaggaacaagctatttggaagcacccgcagccagccccagctgtgaccccagacccctggggagtccagggtgggcaggagagtgaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaactccttag

SEQ ID NO: 22955 - DNA, 2826 bp, Homo sapiens
cagcatcgccttttcctcccgtttctccttccactcccagctccacatcctcctcctattctcccctctcccctcttcaaacccccaccttccagttccctcacctcccctttcggctggtcccctggggcttgcagcaagagggagagagagctcctgacaggattgatggtccttccccaccctgtcctctcatccgctccctccccagcaggcacagacatccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggtgtccagctgctgcctccatatctgtcaaggcatcagaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactggagtctcctttcaggccatcagcagcatggcggacttctgggattttgcccagggcccactactggacagtttgtattggaccaaatggtacaacaaccagagcctgggccatggctcccactccttcatctactatgagaacatgctgctgggggttccgaggctgcggcagctaaaggtccgcaatgactcctgtgtggtgcatgaagacttccgggaggacattctgagctgctatgatgtctactctccagacaaagaagaacaactcccctttgggcccttcaatggcacagcgctggtggtggagtttccagctacaggaggtgccatcccatcctggcaaatccgcacagtcaagctgatccgctatgtcagcaactgggacttctttatcgttggctgtgaggtcatcttctgcgtcttcatcttctactatgtggtggaagagatcctggagctccacattcaccggcttcgctacctcagcagcatctggaacatactggacctggtggtcatcttgctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaagatattcaagtacatcagcttcaacaaaaccatgacccagctctcctccacgctggcccgctgtgccaaggacatcctgggcttcgccgtcatgttcttcattgttttcttcgcctatgcccaactcggctacctgcttttcgggacccaagtggaaaactttagcactttcatcaagtgcattttcactcagttccggataatcctcggggactttgactacaatgctatcgacaatgccaaccgcatcctgggccctgcctactttgtcacctatgtcttcttcgtcttcttcgtgctcctgaacatgttcctggccatcatcaatgacacatattcagaggtcaaggaggagctggctggacagaaggatgagctgcaactttctgacctcctgaaacagggctacaacaagaccctactaagactgcgtctgaggaaggagagggtttcggatgtgcagaaggtcctgcagggtggggagcaggagatccagtttgaggatttcaccaacaccttaagggaactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaaggaacaagctatttggaagcacccgcagccagccccagctgtgaccccagacccctggggagtccagggtgggcaggagagtgaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaactccttaggaaaactt

SEQ ID NO: 22956 - DNA, 2708 bp, Homo sapiens
cagcatcgccttttcctcccgtttctccttccactcccagctccacatcctcctcctattctcccctctcccctcttcaaacccccaccttccagttccctcacctcccctttcggctggtcccctggggcttgcagcaagagggagagagagctcctgacaggattgatggtccttccccaccctgtcctctcatccgctccctccccagcaggcacagacatccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggtgtccagctgctgcctccatatctgtcaaggcatcagaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactggagtctcctttcaggccatcagcagcatggcggacttctgggattttgcccagggcccactactggacagtttgtattggaccaaatggtacaacaaccagagcctgggccatggctcccactccttcatctactatgagaacatgctgctgggggttccgaggctgcggcagctaaaggtccgcaatgactcctgtgtggtgcatgaagacttccgggaggacattctgagctgctatgatgtctactctccagacaaagaagaacaactcccctttgggcccttcaatggcacagcgtggacataccactcgcaggatgagttggggggcttctcccactggggcaggctcacaagctacagcggaggtggctactacctggaccttccaggatcccgacagggtagtgcagaggctctccgggcccttcaggaggggctgtggctggacaggggcactcgagtggtgttcatcgacttctcagtctacaatgccaatatcaatcttttctgtgtcctgaggctggtggtggagtttccagctaggaggtgccatcccatcctggcaaatccgcacagtcaagctgatccgctatgtcagcaactgttctttatcgttggctgtgaggtcatcttctgcgtcttcatcttctactatgtggtggaagagatcctggagctccacattcaccggcttcgctacctcagcagcatctggaacatactggacctggtggtcatcttgctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaagatattcaagtacatcagcttcaacaaaaccatgacccagctctcctccacgctggcccgctgtgccaaggacatcctgggcttcgccgtcatgttcttcattgttttcttcgcctatgcccaactcggctacctgcttttcgggacccaagtggaaaactttagcactttcatcaagtgcattttcactcagttccggataatcctcggggactttgactacaatgctatcgacaatgccaaccgcatcctgggccctgcctactttgtcacctatgtcttcttcgtcttcttcgtgctcctgaacatgttcctggccatcatcaatgacacatattcagaggtcaaggaggagctggctggacagaaggatgagctgcaactttctgacctcctgaaacagggctacaacaagaccctactaagactgcgtctgaggaaggagagggtttcggatgtgcagaaggtcctgcagggtggggagcaggagatccagtttgaggatttcaccaacaccttaagggaactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaaggaacaagctatttggaagcacccgcagccagccccagctgtgaccccagacccctggggaccagggtgggcaggagag

SEQ ID NO: 22957 - DNA, 2966 bp, Homo sapiens
cagcatcgccttttcctcccgtttctccttccactcccagctccacatcctcctcctattctcccctctcccctcttcaaacccccaccttccagttccctcacctcccctttcggctggtcccctggggcttgcagcaagagggagagagagctcctgacaggattgatggtccttccccaccctgtcctctcatccgctccctccccagcaggcacagacatccccctacaaaaggcaggagcccaggctgtgtggaaacagctgctctcagacgcctttccatttgctctctgctggctaggctgggctgtgcctctgctccctcttcctctagctgagagtgggcacctggggtaccgggcccccccacctcattccccatgaatgctgtgggaagtcctgaggggcaggagctgcaaaagctggggagtggagcctgggacaaccccgcctacagtggtcccccttccccacacgggacgctgagagtctgcaccatctccagcacggggcctctccagccccaacccaagaagcctgaagatgaaccccaggagacggcatacaggacccaggtgtccagctgctgcctccatatctgtcaaggcatcagaggactttggggaacaaccctgactgagaacacagctgagaaccgggaactttatatcaagaccaccctgagggagctgttggtatatattgtgttcctggtggacatctgtctactgacctatggaatgacaagctccagtgcttattactacaccaaagtgatgtctgagctcttcttacatactccatcagacactggagtctcctttcaggccatcagcagcatggcggacttctgggattttgcccagggcccactactggacagtttgtattggaccaaatggtacaacaaccagagcctgggccatggctcccactccttcatctactatgagaacatgctgctgggggttccgaggctgcggcagctaaaggtccgcaatgactcctgtgtggtgcatgaagacttccgggaggacattctgagctgctatgatgtctactctccagacaaagaagaacaactcccctttgggcccttcaatggcacagcgtggacataccactcgcaggatgagttggggggcttctcccactggggcaggctcacaagctacagcggaggtggctactacctggaccttccaggatcccgacagggtagtgcagaggctctccgggcccttcaggaggggctgtggctggacaggggcactcgagtggtgttcatcgacttctcagtctacaatgccaatatcaatcttttctgtgtcctgaggctggtggtggagtttccagctacaggaggtgccatcccatcctggcaaatccgcacagtcaagctgatccgctatgtcagcaactgggacttctttatcgttggctgtgaggtcatcttctgcgtcttcatcttctactatgtggtggaagagatcctggagctccacattcaccggcttcgctacctcagcagcatctggaacatactggacctggtggtcatcttgctctccattgtggctgtgggcttccacatattccgaaccctcgaggtgaatcggctcatggggaagctcctgcagcagccaaacacgtatgcagactttgagttcctcgccttctggcagacacagtacaacaacatgaatgctgtcaacctcttcttcgcctggatcaagatattcaagtacatcagcttcaacaaaaccatgacccagctctcctccacgctggcccgctgtgccaaggacatcctgggcttcgccgtcatgttcttcattgttttcttcgcctatgcccaactcggctacctgcttttcgggacccaagtggaaaactttagcactttcatcaagtgcattttcactcagttccggataatcctcggggactttgactacaatgctatcgacaatgccaaccgcatcctgggccctgcctactttgtcacctatgtcttcttcgtcttcttcgtgctcctgaacatgttcctggccatcatcaatgacacatattcagaggtcaaggaggagctggctggacagaaggatgagctgcaactttctgacctcctgaaacagggctacaacaagaccctactaagactgcgtctgaggaaggagagggtttcggatgtgcagaaggtcctgcagggtggggagcaggagatccagtttgaggatttcaccaacaccttaagggaactgggacacgcagagcatgaaatcactgagctcacggccaccttcaccaagtttgacagagatgggaatcgtattctggatgagaaggaacaggaaaaaatgcgacaggacctggaggaagagagggtggccctcaacactgagattgagaaactaggccgatctattgtgagcagcccacaaggcaaatcgggtccagaggctgccagagcaggaggctgggtttcaggagaagaattctacatgctcacaaggagagttctgcagctggagactgtcctggaaggagtagtgtcccagattgatgctgtaggctcaaagctgaaaatgctggagaggaaggggtggctggctccctccccaggcgtgaggttccctataaaagagaagaggaagccttagaggagaggagactctcccgtggtgagattccaacgttgcagaggagttaagtgtgaggcactcccggagcaaagtctatgaaggatcttctgcaagaggctgcctcctggtccactgaacctggaaactgagtgggctttaaccaggagataaaaatggagcctgaagggaatcaggcaaggaaatgaactcaggattcagagatctttgaattaatatgtggtgggttctgacattattcttccataagaccatgtgggtttccatggtggctatcaataaaactccttaggaaaactt

SEQ ID NO: 22958 - DNA, 2202 bp, Homo sapiens
gggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggctagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagatggcaccacaaccaagtacaaaatgagattctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtcttaatatgagacatactgttactaaacataagttcaaataaaaagttgttctgttaaaaaaaaaaaaaaa

SEQ ID NO: 22959 - DNA, 1829 bp, Homo sapiens
gcgcgcaagcgccgcggcctcaggcgaacgaacgggcggtgtagtgcaggtccgccatggctgaggcgtcacggtggcaccgaggcgtgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggctagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatag

SEQ ID NO: 22960 - DNA, 2282 bp, Homo sapiens
aacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggctagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatagtattgagacaagtggagagacagagtctcactctgtcgcccaggctggaacagcggtgcgacagtggcctcaacatcctccaaacagagaatcaagtgatcctcttgcctcagcctcccaagtatctgggactacacgcgaacaccaccacccctggctaatttaaacaaaatttttatacagtctgggtcccactatattgcccaggctggtcttgaactcctggcctcaagggatcctcctgcctcagcttcaaaaactgctgggattataggcatgagccactgtgcctggctagatttttttttaatttttgaaatacagtaatgttttatttaaaaatgggaatgacaataaatatttgcaaatcacacttgaaaa

SEQ ID NO: 22961 - DNA, 2185 bp, Homo sapiens
gaacgaacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgctgttgaaaagtactgaaaaatattcagatttctattttcttgcatgctggcacatttattacaataatataattgctattaccatcttttttgcatggataaagatattcaaattcataagctttaacaagacaatgtctcagctgtcatcaaccttgtcccgttgtgttaaagacatagtaggatttgccatcatgttttttataatattctttgcttatgcccagttaggatttcttgtttttggatcacaagttgatgacttttccacttttcagaattccatatttgcacaatttcgaattgttcttggagattttaattttgctggtattcagcaagccaatcctatcttgggacccatttacttcatcactttcatcttttttgtgttctttgtcctgctgaatatgttcttggcaattattaatgatacctattctgaagtgaaagctgactattcaataggcagaaggctagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatagtattgagacaagtggagtggcaccacaaccaagtacaaaatgagattctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtctta

SEQ ID NO: 22962 - DNA, 2333 bp, Homo sapiens
cgcgcaagcgccgcggcctcaggcgaacgaacgggcggtgtagtgcaggtccgccatggctgaggcgtcacggtggcaccgaggcggggcttcgaaacataagttgcattacagaaaggaagtagaaattacaaccacacttcaggaattgttactctactttatttttttaataaacctatgtatattgacttttgggatggtaaacccacatatgtattacttaaacaaggttatgtcatctctatttttggacacttctgtgcctggtgaagaaagaaccaactttaagtccattcgcagcataactgatttttggaagtttatggaaggaccccttttggaaggtctgtactgggattcatggtacaataaccagcagctgtataatttaaagaacagcagtcgcatctactatgaaaatatacttctaggagttcccagagttcgtcaactaaaagtccgcaacaacacatgcaaagtctattcatcttttcagtctttgatgagtgaatgttatggcaaatatacttctgcaaatgaagacctctctaattttggccttcaaattaatactgaatggagatattctacttctaataccaactccccttggcactggggatttcttggtgtttaccgaaatgggggatacattttcactttatcaaaatcgaaatctgaaaccaaaaacaagttcattgaccttcgactgaacagctggatcacaagagggactagagttatttttattgatttttccttatataatgctaatgtaaatctattttgtattatcagattggtggcagaattccctgcaactggaggaatacttacttcatggcagttttactctgtgaagctcctcagatatgttagctactatgactattttattgcttcctgtgaaatcacattctgtatttttctttttgtcttcacaacacaagaagtcaaaaaaataaaagaatttaagtctgcctatttcaaaagtatttggaactggctagaattgctacttttgctgttgtgttttgtggctgtttccttcaacacatactataatgtacaaatttttctcttacttggacagctgttgaaaagtactgaaaaatattcagatttctattttcttgcatgctggcacatttattacaataatataattgctattaccatcttttttgcatggataaagaatatgttcttggcaattattaatgatacctattctgaagtgaaagctgactattcaataggcagaaggctagattttgaacttggcaaaatgattaaacagagttacaaaaatgttctcgagaaattcagactgaagaaagctcaaaaagatgaagacaagaaaaccaaaggcagcggagatttggctgaacaagccagaagagaaggctttgacgaaaatgagattcaaaacgcagagcagatgaaaaaatggaaagagaggcttgagaaaaagtattattctatggaaattcaagatgactaccagcctgtcactcaagaagaatttcgagaactttttttatatgctgtggagctggagaaggaattacactacatcaatttgaagctaaatcaagtggtgagaaaggtttcagctctatagtattgagacaagtggagtcattctgtaagaaaaaggcaacagaagaattcagtatgaagattttcctccaattttcttcagtaatgagaaacaaaaagttggtaataacaaaaagcttgcatttccaaagttcttgaagttgaaaggataaaattccagtcttttgctaaaaggatgtatctgtagtacaaaacaatgaagtaaaccatatgtttgctaaaggtggagaggacagtctgtggttaatatggaacatcacttacgctcccttgagagggcctacttactctcccatcatttgttttgtttagtggcaccacaaccaagtacaaaatgagattctctgagtgcctgacaaaacgaatttaagtaccagccaagtacacacgatgatagcttcaaggaatacaactgactttatgatatgaattttcaaggaacgtatcttatatggattttgaagaatcttgtttgcttataagaacttcaagaagcctaagcttggctttaattttcttgtactctctgtactcctcaagcactggaacacgatcctctttctgggcattcctaggggagaaaataaaatttgtaatgttctagagatcatttggaaaaaaagatccaaaagttgtcttaatatgagacatactgttactaaacataagttcaaataaaaagttgttctgttaaaaaaaaaaaaaaa

SEQ ID NO: 22963 - DNA, 1110 bp, Homo sapiens
agaggaacagggccctggagcacctggtttcggggacagtagggttggtgggagttgcgatgatattgccacctacctcttacatcttttagtgcgtatgttctgtccacccagctactggttcatttgagtagatcggagtcagatgagtacatgtttacgggaggcgcttggttacgggatccagataggaatctttatctgagctgcttgtcagtttgttcgtctgtccctaggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 22964 - DNA, 664 bp, Homo sapiens
caggctcggggagtgaaggcctcgttgagagaaggtctcattcggtgttttgggaagagagtcgtgtgggcccaggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 22965 - DNA, 374 bp, Homo sapiens
agttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcccgggctggagtgcaatggtgtga

SEQ ID NO: 22966 - DNA, 1056 bp, Homo sapiens
tgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtaacgttggggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 22967 - DNA, 760 bp, Homo sapiens
tgcctcctgagcgtagtccagttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 22968 - DNA, 965 bp, Homo sapiens
agaggaacagggccctggagcacctggtttcggggacagtagggttggtgggagttgcgatgatattgccacctacctcttacatcttttagtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctgcccacc

SEQ ID NO: 22969 - DNA, 744 bp, Homo sapiens
gaacagggccctggagcacctggtttcggggacagtagggttggtgggagttgcgatgatattgccacctacctcttacatcttttagtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccc

SEQ ID NO: 22970 - DNA, 1020 bp, Homo sapiens
agttactttcaggctcggggagtgaaggcctcgttgagagaaggtctcattcggtgttttgggaagagagtcgtgtgggcccaggtatcgtagcggcgacacgagagagacgggcggtgtgacagccttccactacctgcacgagtgtattggtctgtctgctatcagctatgccgctgcccgttgcgctgcagacccgcttggccaagagaggcatcctcaaacatctggagcctgaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagatgctgaagaaaagttggaccggagccatgacaagtcggacaggggccatgacaagtcggaccgcagccatgagaaactagacaggggccacgacaagtcagaccggggccacgacaagtctgacagggatcgagagcgtggctatgacaaggtagacagagagagagagcgagacagggaacgggatcgggaccgcgggtatgacaaggcagaccgggaagagggcaaagaacggcgccaccatcgccgggaggagctggctccctatcccaagagcaagaaggcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcagaggcctcccgaaccaagcagcaggattgaagcttcggcctccctggccctgggttaaaataaaagctttctggtgatcctg

SEQ ID NO: 22971 - DNA, 451 bp, Homo sapiens
atattgccacctacctcttacatcttttagtgcaaccagaggaagagatcattgccgaggactatgacgatgatcctgtggactacgaggccaccaggttggagggcctaccaccaagctggtacaaggtgttcgacccttcctgcgggctcccttactactggaatgcagacacagaccttgtatcctggctctccccacatgaccccaactccgtggttaccaaatcggccaagaagctcagaagcagtaatgcagcagtaagccgaaaggatgaagagttagaccccatggaccctagctcatactcagacgccccccggggcacgtggtcaacaggactccccaagcggaatgaggccaagactggcgctgacaccacagcagctgggcccctcttccagcagcggccgtatccatccccaggggctgtgctccgggccaatgcaga

SEQ ID NO: 22972 - DNA, 2511 bp, Homo sapiens
agcgctgcggttggcagcggcgggatggagaagctgggggtggagccggaggaggaaggcggcggcgacgacgacgaggaagacgccgaggcctgggccatggaactggcggacgtgggggcggcagccagctcgcagggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaacatagaa

SEQ ID NO: 22973 - DNA, 2025 bp, Homo sapiens
aagtagcgctgcggttggcagcggcgggatggagaagctgggggtggagccggaggaggaaggcggcggcgacgacgacgaggaagacgccgaggcctgggccatggaactggcggacgtgggggcggcagccagctcgcagggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtgtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagc

SEQ ID NO: 22974 - DNA, 6131 bp, Homo sapiens
atgcgtgtcactctgggcaacaggctggtcggccacgactgcgcaggcgagaggcacagagcgactggagactgtagtcccccggtttccctggagaccaggcggaagcggccggaagtagcgctgcggttggcagcggcgggatggagaagctgggggtggagccggaggaggaaggcggcggcgacgacgacgaggaagacgccgaggcctgggccatggaactggcggacgtgggggcggcagccagctcgcagggagttcatgatcaagtgttgcccacaccaaatgcttcatccagagtcatagtacatgtggatctggattgcttttatgcacaagtagaaatgatctcaaatccagagctaaaagacaaacctttaggggttcaacagaaatatttggtggttacctgcaactatgaagctaggaaacttggagttaagaaacttatgaatgtcagagatgcaaaagaaaagtgtccacagttggtattagttaatggagaagacctgacccgctacagagaaatgtcttataaggttacagaattactggaagaatttagtccagttgttgagagacttggatttgatgaaaattttgtggatctaacagaaatggttgagaagagactacagcagctgcaaagtgatgaactttctgcggtgactgtgtcgggtcatgtatacaataatcagtctataaacctgcttgacgtcttgcacatcagactacttgttggatctcagattgcagcagagatgcgggaagccatgtataatcagttggggctcactggctgtgctggagtggcttctaataaactgttggcaaaattagtttctggtgtctttaaaccaaatcaacaaacagtcttattacctgaaagttgtcaacatcttattcatagtttgaatcacataaaggaaatacctggtattggctataaaactgccaaatgtcttgaagcactgggtatcaatagtgtgcgtgatctccaaaccttttcacccaaaattttagaaaaagaattaggaatttcagttgctcagcgtatccaaaagctcagttttggagaggataactcccctgtgatactctcaggaccacctcagtcctttagtgaagaagattcatttaaaaaatgttcatctgaagttgaagctaaaaataagattgaagaactacttgctagtcttttaaacagagtatgccaagatggaaggaagcctcatacagtgagattaataatccgtcggtattcctctgagaagcactatggtcgtgagagtcgtcagtgccctattccttcacatgtaattcagaaattagggacaggaaattatgatgtgatgaccccaatggttgatatacttatgaaactttttcgaaatatggtgaatgtgaagatgccatttcaccttacccttctaagtgtgtgcttctgcaaccttaaagcactaaatactgctaagaaagggcttattgattattatttaatgccatcattatcaactacttcacgctctggcaagcacagttttaaaatgaaagacactcatatggaagattttcccaaagacaaagaaacaaaccgggatttcctaccaagtggaagaattgaaagtacaagaactagggagtctccactagataccacaaatttttctaaagaaaaagacattaatgaattcccactctgttcacttcctgaaggtgttgaccaagaagtcttcaagcagcttccagtagatattcaagaagaaatcctttctggaaaatctagggaaaaatttcaagggaaaggaagtgtgagttgtccattacatgcctctagaggagtattatctttcttttctaaaaaacaaatgcaagatattcccataaatcctagagatcatttatccagtagcaaacaggtatcctctgtatctccttgtgaaccgggaacatcaggctttaatagcagtagttcttcttacatgtctagccaaaaggattattcatattatttagataatagattaaaagatgaacgaataagtcaaggacctaaagaacctcaaggattccactttacaaattcaaaccctgctgtgtctgcttttcattcatttccaaacttgcagagtgagcaacttttctccagaaaccacactacagatagccataagcaaacagtagcaacagactctcatgaaggacttacagaaaatagagagccagattctgttgatgagaaaattactttcccttctgacattgatcctcaagttttctatgaactaccagaagcagtacaaaaggaactgctggcagagtggaagagagcaggatcagatttccacattggacataaataagcatattcagcaaaaaggtctgaaaagcaagggaataccattattttcggattagcggtttattaagctcttctatattaaacactaatagatattcaataacggagtaaactgttccagataaagcaagaatagttgcaagaagtaaattctggcacaaagcgtaaaaatataacagaagaaataatgtaaaatactatcttttatgtctaaagccattttatattacttttcaataaaaagaatatcatggtcaacatagaatatttttcatgaattggtggggagatgtatatgtttatatataaaaaatagccaaatcgttgcaatgatatggtaaaggacacattttttttttttttttcctgtgaaatgtggaatatctcaaattcagcctcttaggctgaatagcaaatcctactgccaactaacctattaaaaatatagatagttttgactaaagtactacattacatttagtatgttgacttttaaaataccaaagcaatttatattcaattaatgcttcttcatacaccaagaatctaccacaatacacagcacacaaaggccgttcaataaacattgaatgaatgaatggtttggctagggccagggtggggagttaaagtgagaggagggtatatgttatagagaacagtggtagaaggaactctccgtgcaagtaaattaagggaaagatggacaccagaaaggcaaggtgatgggcctataagcatactggataatggaagaagtccatttctttctagctagtttgaagggcctaaaagcactgagatgtttttgtatcttccctacatttggagatgatattaggttgtcataacaaccacaaatatagaccattactaaattggtggatgtcctctttctcccattgttattgccttcctcttttgcctgctaaactaaaaattggatataagattgagaatgtattatataatttgcaagacatagaggatgtttatagaatatactaaagtatccctcagcaccaatatgggagtatcctggtctcaagtttataatttttgcacatataatctaaagaagagactttaaaaataaagtacacaaatatgaaccaaagagtagcttaaaaatactttcttctaggtctgaaattttcttttctttctttttttgttttggagacagagtctcactctgtcgcccagggtggagtacagtggcgcaatcccagctcactacaacctccgcctcccaggttcaagcaattctcctgcctcagcctcctgagtagctgggattacacgcatgccctaccacacccagcaaatttttgtatttttagtagagatgacatttcaccatattggccaggctggtctcgaactcctggtctcaggtgatcctccaccttggcctcccaaagtgctgggattacaggtgtgagccattgctcctggccccagctctgaaattttaacttagttttggattccttggaatttgaaaatatgctaacacgaaggattgtaaataggtagtttgaggttatcaggaacagtaacttgaagcaagaacatcagaaattgttcaccatgcaaatatttagtactctgaatcaaggaacatagtattttttacatgagtattccagtaaggtaattaaacttatgaaaagggtatataactttttgtaaatcattaaaacattttatagtccttgtaatgatttcaggaccttggacagctagaaggggcttaagaaaaaatggctaagaaaacaaagtaaatggttttggccagcttaaaaagagaaagcaaaatagttaaaaatacatttcatagattgagaatgtacgggctatgtcacagttacgctacttattttgtggttttaagttagtctcaacatctttgggcctcagaatcaacttttttatgggatcttttttctctgtttttaagattatctcttttttctttggtgctttgcaggtttactgtattatttggaagtgcgaatttatttttattcttagtatatactggcttcttcctgtatcttttaattcatgttctgtaaaattctcaaccactagctcttcaaatatttcttctctattctaggactgtatacaaatgatagactttcttactgtatccttcatgtctcttaatttctcatatttttcatcctcttgtttctctttactgcattttgggtaatttcatcagctctatctttctgtttactagttcatttttcagtagcatctcacctgctatttaaaacaatgatggttttaatttcaataaatatatttttcatttgattctttttaacttcccgtttactcattacagtcccttgtaagtctgtttctaatttttaaaagtcaaatatatgatatttttgataatttcaatattttaagtctttataagtctacatttaaggttattattgcatatcattgtgacttatttccttgagtatgtgttaatctgcgagaagacagagggcctaaattgtgtatgttttccttcagtatgatttgagttcgttgcttctctgggtgaggtggtacaaactccttggcatactctattcacctttgtggatcctgattgaatgccttgtcttaagtgtaagctccctgacccttactactagccgaaggttttgtctctgcaggtcaattccaaactaacaggcagatgctgttagctatctgcctccagggataaaccccatctttcaagcttgcttcttgcttgatgctttctgctgctttcttgcttttgtttcagctcgagtttgttgttgttttttttttttcctgtttctgtcttgaatgtagagggtatttttatttttattttttctgtttctctcttgagtgtatagtgtagagggggtttctgtcttgagtgtaggcctggagatttcccttatatggtacaaaccagcaatgaattaagaggtctcttttctccaagatctagtgttttgtactaggagaactctaaaaagtatctattccactgtagtgccaaagtacaaatttatttggatttattttttgccatcttattttttaatatatttctttttctatgttgtgcttctttcccacctttatctctcctcctatcttttgggatcagttgggttttctatttaatcatatattttccctttactgatttggaatgtgaatgttacaagtccttttgattatccttaaacatctaaaaatgctaccctctttccaaacaacacaaaggtattgaaataacattaattctaattaaattccacaagttctttattaaatctccaaattggatattattagtattttatatagtcaatgtttatttttttgatgggacatggtgggggcttaccttttttcttgtgtgtcagatgttccttctaggtagaattctttataccttctgaaattatgtccttagagctgtagatttagaactgacatctcttgagctgttctaagataatatcttttactttggagatacgcagtttttattatatgtctagctatagatttatcatggatttaggttcattatgaatctgcagatttgtgtcttccatcaaatctggattgttttcaatattaaaaaaacttctattttaaaatctgtatatagaaaggtacataaacataaatgaacatgttaatgagtaattgtaacaactatgtaactgtccaagtcaagaaataaaacatatcaagt

SEQ ID NO: 22975 - DNA, 5911 bp, Homo sapiens
tacctccggctctcccgggtgacgacgggtagaaaagcaggaggagcggagaaaggagagggcggggtagggatgcagctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaatagagatggttttctacttttccactcttcctccctcttatgccttcacttttgttttctgtgcccagaattttcttcacattctttactacctgttttgtctattatatccaacccattttctttttattataattttgatttggggcatttgaagaaaatacagcaaaactacaagaactggtaataagcatgcataatctcacctacttagtgaacctaatataaacctaatataaagaaccaccgtatttgcaatatatataactggtgaaaaactagtgtccagaatatataaatgatccctatgaatcagtaagaaaaagacagtcaatagaaatttggacaaaagactttatatggcatttcaagtgaaaggaaatccagatgaccaagaaacatgaaaatattcccagccatattaatatttgagaagtaaaaaataaaactacaaggaggtattacatctttaccttatttgcaaaaatgaaatgatctaatgatactaagttttggtgatgatgtcagctcttacattgaaaacaatcactgtggaaaaatttgtccctcagtaaatttaaagataaacatgctcaaaacctagcaattgcactctgaagtatacatctttgcaggttatctttcattacagttatttttttccctgtcaggaccctaactaatacaatgccttgggaaaactaatgaacatgtatcctaggaagcatgtacaagaaagttcttcccagtcaggaaggtggccaagaaaaaaattttttaatgttcatagcagcactgcaatatccaaaagttagaaatgaaccaaatattcagcaatggtagaatggttaaattgtaccatggcatttatattgaaacagtagaattctacacagtggtgaaaatgaaggaaatagctaaccacaacatagatgaatatcacagacatagcatagagcaaaagaagcaaatcacagaaggatgccatcaacatgattccatttgtataaagtttaaaacagtataaactgaacaactatattgttttaagggtatatagttatatatatgagatacaactgtaaagaaaagcaagtgttttgctgtccccagaaccagaataatgatttcctctgtggagaagtacagcagtgtgattggggagtggcacctggtgcttctgggatgctggcaatgttctatttcttgtcttgggtggtgattgcatggatgttcacttttaaaatactctttatacatatatattttatatattcttgttcatatataacctttataataaagagaaaaaaatggcaaaaa

SEQ ID NO: 22976 - DNA, 3918 bp, Homo sapiens
agctgtgctgcattctgggaagggcgttggtccgtcgctcgcgcagcctcctgggagttgtagtcgcgatcctgaggtaacggataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaaacattgaacattttatcattaatttttaattgaaactagttattttataatcaatgaatttgttctttctgattttaagtttgcagatttatttagtgaaggcaagtgcaataatccttcctcagatgatgtttgcttttctaagatacatatactgattctgtgtatcttttttataaccatgagaattttacttccattatacatcaattggaaatcaatcctgttaagagataattcttaaaagggaaattaggaatgggataagaaggtgatttttttattatttttatactgaatataaaaacatttgtaagggctctcaaagattcacacatgcctatattatcataagaatttttcagcacttaactactttgttggcattgatcctagtgtctttaaatacttcatgagcattcataattaaaatttatcttaagttctatgaagagtattaatgtaactagcataagtggttttcttcaggaaaataaatatcacagtattatctgtgttaaaatggtttttgcctaaaatataatttttaatttggcttttcttatttaaaattccattatcttatgaataagcacttgaatcagtttttaaaatatttagtctaagatgattcaaagtagttttattttaatacaggacttttaaatggcagtatttcatttcttgtcaattatgttggtactttccacaaatctataaagaaggataaattgtaccatcattttattataatcctcaagagaaaatgtgtaattcaaaagattaatgtgtattaaaacacattatgtatcttagttacatttctatcagtacttttattaatatttgtgaaagaagacagcttaatagtagttagcttaagtagtttctccaagtacttttgtgctatcaatgagttcttctcaaaaaataattagttaggccaggcacaatggctcacacctgtaatgccagccctttgggaggccgaatgggcagatcacttgaggtcaggagtttgagaccagcctcgccaacatggtgagaccctgtctctactaaaacgataaaaaaaaaaaaaaaattagccaggcttggtggcacacgcctgtaatcccagctactcagatggctgaggcaggagaactacttgaacctgggaggtcaaagctgcagtcagccaagatcttgccactgtactccagcctgaagagcgagactctgtctcaataatataataatagttattatttaattgcaacatgaagttggaagccattttctgttacttctttaaggagctaaatcttttatatttttgttttctctccccttgcgtttcatattttagcttatgatctaaatatatattttgtatattataatattttaggaatagcttaattaagaactcacagactttgacaaagtggtaactagacttttaattactagattcttcaaattaggcttaatgcctgctagcatgccaatccaatcccatgactgatgttattatacactatggcaaatacaaagttgtagtattatggttcttgatggtgtgatttacttatgtaaattatgtacaaatttaagttcaatgaaacactgatttaatgtactgaaaggtaaatagtaccatagtgaattattttctgtcttgccttaggtttatttttattatcttcaatattagaataaatgctaaattattttcatttaaggatttatgtagttgaatattatcatttagtaatatttaatcatttgaaataaaatttaaagctttaattgatctaa

SEQ ID NO: 22977 - DNA, 2727 bp, Homo sapiens
atggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacagattaacatcaaattttaacattataaaagcaattctacagaggaacatttacattatgctacagtatcttcagttgtaccttcctgttcagcataaacatcatatgccaaagaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaagggtagaactgttaccattaagttgaagaatgtgaattttgaagtaaaaactcgtgcatctacagtttcatctgttgtttctactgcagaagaaatatttgccattgctaaggaattgctaaaaacagaaattgatgctgattttccacatcccttgagattaaggcttatgggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaa

SEQ ID NO: 22978 - DNA, 1484 bp, Homo sapiens
atggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaaggtagctcaagtggagtacagaaggctgtaacaagaacaaaaaggccaggattgatgacaaagtactcaacatcaaagaaaataaaaccaaacaatcccaaacatacccttgatatattttttaagtaa

SEQ ID NO: 22979 - DNA, 2019 bp, Homo sapiens
atggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaa

SEQ ID NO: 22980 - DNA, 2441 bp, Homo sapiens
atggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaaggtgttcggatatctagttttcccaatgaagaggacaggaaacaccaacaaaggagcattattggctttttacaggctggaaaccaagccctgtcagccactgagtgtacattagagaaaactgacaaagataagtttgtaaaacctctagaaatgtctcataagaagagtttctttgataaaaaacgatcagaaaggaaatggagtcaccaagatacatttaaatgtgaagccgtgaataaacaaagtttccagacatcacaaccattccaagttttaaagaagaagatgaatgagaatttggaaatatcagagaattcagatgactgtcagatacttacctgtcctgtttgctttagggctcaagggtgcatcagtctggaagccttgaataaacatgtagatgaatgtcttgatggaccttcaatcagtgaaaactttaaaatgttctcgtgttcacatgtttctgctaccaaagttaacaagaaagaaaatgttcctgcttcttcactttgtgagaagcaagattatgaagcccatccaaaaattaaagaaatatcttcagtagattgtatagctttagtagatactatagataactcatctaaagcagaaagcatagatgctttaagtaataagcatagcaaggaagaatgttctagtctcccaagcaagtcttttaatattgaacactgtcatcagaattcttcttctactgtttcattggaaaacgaagatgttggatcatttagacaagaataccgccagccttacttatgtgaagtgaaaacaggccaagctctagtttgtcctgtttgtaacgtagaacaaaagacttcagatctaaccctgttcaatgtgcatgtggatgtttgcttaaataaaagttttatccaagaattaagaaaggataaatttaacccagttaatcaacccaaagaaagctccagaagtactggtagctcaagtggagtacagaaggctgtaacaagaacaaaaaggccaggattgatgacaaagtactcaacatcaaagaaaataaaaccaaacaatcccaaacatacccttgatatattttttaagtaa

SEQ ID NO: 22981 - DNA, 1536 bp, Homo sapiens
tgagagagctttccgctgaagatgacgggcctgctttccagggcggcttgtcgaaagcccgggagcatctggccgcttccgcctcaaccatgggctggggttttgtgagctactagtgccaagggttttctttccaccagaccaccgctgtaaatctcgagggtcttactcattagaagttagaattcacatttgacgtttaaaggaagaatttccttagtaccttctcacaagcacgcacttcgcatttttagatttctagagtttgctttgtagaaagtaattttgaggttgtcagagaataaatgacgttagaaaggtttttaaagtaaaacaagaatgtgagatgatagcctgggattttctcttggttgtaaatgaatatcttactgagaaccacgttaaccatgcctgcccctcaaagataggaaaggttggatatatagaaactttctcgtattagaaataccgaagtgcagtggttttgtgtgtacaagggattaggcaataggaggctatttttgttttaagactagggttgaattagcagaaagaccaatagaagatctaacaactcttgtcagttgtcaaggataactttgattatgagactttgactttgtagcttcagtaatttcctctcgttagctattttaatatagtcgatttccttgtaattgccaagagtaaaatttgttattaaaccttagaaagagtactttcttactacaaggatgggacgataggagcgaaatttcgagtctaagggaaaacgctggccgagtgtggtggctcacgcctgtaatcccagcacttcgggaggccgaggtgggtggatcacctgaggccgggagtttgagaccagcctgggcaacaagatttttcttcatccctttactttgagtctgtggatgtcattgcatgtgatatgggtctcctgaagacagcataccattggattttgcttctttatccaagttatcattctgtcttttaattggggtgtgcattcaagataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgcccccca

SEQ ID NO: 22982 - DNA, 1438 bp, Homo sapiens
ataagtttataccatggatagcacaaaggagaagtgtgacagttacaaagatgatcttctgcttaggatgggacttaatgataataaagcaggaatggaaggattagataaagagaaaattaacaaaattataatggaagccacgaaggggtccagattttatggaaatgagctcaagaaagaaaagcaagtcaaccaacgaattgaaaatatgatgcaacaaaaagctcaaatcaccagccaacagctaagaaaagcacaattacaggttgacagatttgcaatggaattagaacaaagccgaaatttgagcaataccatagtgcacattgacatggatgctttctatgcagctgtagaaatgagggacaatccagaattgaaggataaacccattgctgtaggatcaatgagtatgctgtctacttcaaattaccatgcaaggagatttggtgttcgtgcagccatgccaggatttattgctaagaggctgtgcccacaacttataatagtgccccccaactttgacaaataccgagctgtgagtaaagaggttaaggaaatacttgctgattatgatcccaattttatggccatgagtcttgatgaagcctacttgaatataacaaagcacttagaagaaagacaaaattggcctgaggataaaagaaggtatttcatcaaaatgggaagctctgtagaaaatgataatccaggaaaggaagttaataaactgagtgagcatgaacgatccatctctccactactttttgaagagagtccttctgatgtgcagcccccaggagatcctttccaagtgaactttgaagaacaaaacaatcctcaaatactccaaaactcagttgtttttggaacatcagcccaggaagtggtaaaggaaattcgtttcagaattgagcagaaaacaacactgacagccagtgcaggcattgccccaaatacaatgttagcaaaagtatgcagtgataagaataaaccaaatggacaataccaaattcttcccaatagacaagctgtgatggacttcatcaaggatttacccattagaaaggtttctggaataggaaaagttacagagaaaatgttaaaggcccttggaattattacatgtacagaactttaccaacagagggcattgctttctctccttttctctgaaacatcttggcattatttccttcatatctccttgggtctaggttcaacacacctgacgagggatggagagaggaaaagtatgagcgttgagaggacattcagtgagataaataaagcggaagagcaatacagcctatgtcaagaactttgcagtgagcttgctcaggatctacagaaagaaagacttaaggtgctttattttgatatggtgtccttagtttttaagttttttaatagtaaaatgctaccttaaaagcta

SEQ ID NO: 22983 - DNA, 2835 bp, Homo sapiens
atggaaaattatgaggcattggtaggctttgatctctgtaatacaccgctctccagtgttgctcagaagattatgtctgctatgcattcaggtgatttagtggattctaagacttggggaaagagtacagagactatggaagtgataaacaagtccagtgttaagtattcagtacaacttgaagacaggaagactcaatcaccagaaaaaaaggatcttaaatctttaagaagtcagacatcaagaggttctgccaagctgtctcctcagtccttcagtgtcaggctcacagatcagctgtctgctgaccaaaaacagaagagcatcagctcattgactctttcaagttgtttaattccacagtataatcaagaggcttcagttctacagaaaaaggggcataaaagaaagcatttcctaatggagaatataaataatgaaaataaaggaagcattaatcttaaaagaaaacatattacatataataatttgtcagagaaaacaagtaaacaaatggcattggaagaagatactgatgacgccgaaggctacctaaattctgggaactcaggagcattgaaaaaacatttttgtgatattaggcatttggatgattgggcaaaaagccagctgattgaaatgctcaaacaggcagcagccctggtgataactgtgatgtatactgatggttccacccagctaggagctgaccagacccccgtttcttctgttagaggaattgtggtgttagtaaaacgccaagcagagggtggccatggctgtccagatgccccggcctgtggtcctgttctggagggctttgtgtcagatgatccatgcatctacattcaaatagagcactctgctatctgggaccaagaacaggaggcacatcaacaatttgcccggaacgtgctatttcaaacaatgaaatgtaaatgtcctgttatttgttttaatgctaaggattttgtgagaatagtgctgcagttttttggcaatgatggcagttggaagcatgttgctgattttatagggctagatcccagaattgctgcatggcttatagatcctagtgatgccacaccctcttttgaagatttagtagaaaaatactgtgaaaaatccattacagttaaagtgaacagcacatatggaaattcctcaagaaatattgtgaatcagaatgtacgtgagaacctgaagacactctacagacttacaatggacctttgctctaaactgaaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcagtgttaaatgctctgcgagaccttcatccattacccaagataattttggaatacaggcaggttcacaagatcaagtcaacctttgtagatggattactagcttgcatgaaaaagggctccatttcctctacatggaatcagactggaactgtgactggaagactttcagccaagcatcctaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaaggctccgctgctgacctctgcaagctggccatgatccatgtcttcactgcagtggctgcttcccacaccttgacggccaggctggtggcccagatccatgatgagctgctgtttgaagtggaagatccgcagatcccggagtgtgcagctctcgtcaggaggaccatggagtccttggaacaggtacccctcaaggtgagcctgagtgccggccgctcatggggacacctggtgccactgcaggaggcctggctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatcctt

SEQ ID NO: 22984 - DNA, 3564 bp, Homo sapiens
atggctgtggggagccaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcagtgaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaagctcagagccagcacctctgtgtggaggtaccgtgagagctgtggcgatggtgcagaatgctgagtgcaccatgaaccgtgtgccatgggacctcaagacagtaccacgcgccccataggctccgctgctgacctctgcaagctggccatgatccatgtcttcactgcagtggctgcttcccacaccttgacggccaggtcagtgggtggtggtctcccagggcttggatgggagggttagtattctgtgggaagaccccctcggggctcgtgattctgatgatcaccatctctgcttatcgggcccccgtcccctcctgaggctctcagcccatggaaggccctgggggctactcacagcaggcatgcagacaacaaccagccatccaccagcgtggggtgcagatgaggcctctccagacagaaatgctgtctcccccagacccctcctcctcggggtgtctgcacagcacaggggcaccccttgaggctgcccaccccagaggcaggcgaacccctcagccccttgagcaggaccctggggactccaaactgcccccacccctgcctgttgctgccaccaatgccaggcagtgtgccccacgcccagctctgcccccacccctacctgttgctgccaccagtgccaggcagtgtgccccacgcccagctctgcccccacccctacctgttgctgccaccagtgccaggcagtgtgccccacgcccagctctgcccccacccccgagcccagagccaacatgcagatgtgccttggtgggggggggctccgccctggctgccccccaggccacagctctctcaggcctctgtccctgcctcagttattcccccagggcacattcctcaagagtgtgggtggccaggggacaagcagccctcgcccagccacctcctccttgccagccaaggcctgggggtgctgcaagtggtgacccagacacctcctctcctcgttctccttgtgcgggatcccctcaggagtcccggagccccttctgggagctaacctgccccagccccccacagtgtcagtccccgaagggcccctcgccctctgacacaccatggacgttttcccacccccaccctaagagccctcaagctcttggcgacagtcccgtgggggtctaagcactgccccagggactctgcttgcagcttcactgggctgtgggctctcagtgctgctttctgcagtaactgaagtggtcagaaggcaggagtggggcattagaagattcactctcggctgggcacagtggctcacgcctgtaatcccagcactttgggaggccgagacgggtggatcacctgaggtcaggagtttgagaccaacctggccaacagggtaaaacatcgtcactactaaaaatacaaaaattagccaggtgtggtggcgcacacctgtaatcccagctactcaggaggctgaggcaggaggatcgcttgaacccaggaggtggaggttgcagtgtgccaagatcgcaccactgcactccagcctgggtgagagcaagactctgtctaacagaaaaaaaaataagattcactctcagtcctctcctgccccatctcactgccatctgcattcattcccaacacacacgtgcacacacacgcacacacaagcacatgcacccatacacgtgttcacccatgcatacaacccatgcacacacatatacgcatatacactgatgccaggcagcctctagtgccccacagtgttctcatggtgtcctgaaatccatgcatcccgctcacttccacagtttctgcaggtaaattatagcttctcccaggatatgagcagcttgtgctagtttccgtcttggcaggaactgaaagccaaatggtggtcctgcctctaagatactgcaagtctagaaaagttgattcaaggctgggcgcagtggctcacacctgtaatcccagcatttgggaggccgagtcgggtggatcacttgagctcagaagtttgtgaacaacatatgtgttgcctgggcaacataatgaaacctgtctctacaaaataaaagctggccatggtggtgcacacctgtagtcccagctactcaggaggctgaagtgggaggatcacctgagcctgggagttcaaggctgcagtgagccatgatcataccactgcactccagcctgggcaacagggcaagaacctgcctcaaaaaaagaaaaaatcggttcactttcagcccttgtggaattgataaaggaagttggcatgtgaggagctgaggtctctctctgttgctgactgagtccttctgaaagctggacacagacacttttactcaggaacgcagttactcgctggtcatccttctgtcatcagccattggctgtcacgaggaaatgcttctcatagcaaaatgcaaagcagactcgtgtggaatattgggcacatggtctgtgttttgtgaacgtgatttgttcttccaggagtaatgtgaaaggctgtggatggcgtctggaagggacgggtgcaggctcagtgtggccaggcatctctcgctgaagcagcaggcatgaaactcgatcactgggaggcacacggtgcccctagagtgagctgagatcgcaccacttcactccagcctgggcgagagcgagagtctgtct

SEQ ID NO: 22985 - DNA, 2899 bp, Homo sapiens
atggaaaattatgaggcattggtaggctttgatctctgtaatacaccgctctccagtgttgctcagaagattatgtctgctatgcattcaggtgatttagtggattctaagacttggggaaagagtacagagactatggaagtgataaacaagtccagtgttaagtattcagtacaacttgaagacaggaagactcaatcaccagaaaaaaaggatcttaaatctttaagaagtcagacatcaagaggttctgccaagctgtctcctcagtccttcagtgtcaggctcacagatcagctgtctgctgaccaaaaacagaagagcatcagctcattgactctttcaagttgtttaattccacagtataatcaagaggcttcagttctacagaaaaaggggcataaaagaaagcatttcctaatggagaatataaataatgaaaataaaggaagcattaatcttaaaagaaaacatattacatataataatttgtcagagaaaacaagtaaacaaatggcattggaagaagatactgatgacgccgaaggctacctaaattctgggaactcaggagcattgaaaaaacatttttgtgatattaggcatttggatgattgggcaaaaagccagctgattgaaatgctcaaacaggcagcagccctggtgataactgtgatgtatactgatggttccacccagctaggagctgaccagacccccgtttcttctgttagaggaattgtggtgttagtaaaacgccaagcagagggtggccatggctgtccagatgccccggcctgtggtcctgttctggagggctttgtgtcagatgatccatgcatctacattcaaatagagcactctgctatctgggaccaagaacaggaggcacatcaacaatttgcccggaacgtgctatttcaaacaatgaaatgtaaatgtcctgttatttgttttaatgctaaggattttgtgagaatagtgctgcagttttttggcaatgatggcagttggaagcatgttgctgattttatagggctagatcccagaattgctgcatggcttatagatcctagtgatgccacaccctcttttgaagatttagtagaaaaatactgtgaaaaatccattacagttaaagtgaacagcacatatggaaattcctcaagaaatattgtgaatcagaatgtacgtgagaacctgaagacactctacagacttacaatggacctttgctctaaactgaaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcagtgttaaatgctctgcgagaccttcatccattacccaagataattttggaatacaggcaggttcacaagatcaagtcaacctttgtagatggattactagcttgcatgaaaaagggctccatttcctctacatggaatcagactggaactgtgactggaagactttcagccaagcatcctaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaaggctccgctgctgacctctgcaagctggccatgatccatgtcttcactgcagtggctgcttcccacaccttgacggccaggctggtggcccagatccatgatgagctgctgtttgaagtggaagatccgcagatcccggagtgtgcagctctcgtcaggaggaccatggagtccttggaacaggtgcaggcattggagctgcagcttcaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatccttgtctgagtgaattcttcctgtgagtgggaagtg

SEQ ID NO: 22986 - DNA, 3253 bp, Homo sapiens
agtgcgaggcgcgcggggcacggagggcggtggcggcgggctcctgcgagaagcaagcggaacttcctgagcgtgcttaggtgtcacagctgggtgaccctccgaaggaaggttttgccgctggcgcgtctggtgtatcgcggccttggggccgcggatccctggggcttgccgctgcctctggggttcgcgcggccctggcgtcggggctgcctcagcgctggctgaaggccggcccgaagcacccttaattgtggccgcgcgcttccctgctgctcctgctgttctccgcgtcgcggtggtggactctggaggtggagccttgcccggcgagacgttgaggattttgtgaaaatggaaaattatgaggcattggtaggctttgatctctgtaatacaccgctctccagtgttgctcagaagattatgtctgctatgcattcaggtgatttagtggattctaagacttggggaaagagtacagagactatggaagtgataaacaagtccagtgttaagtattcagtacaacttgaagacaggaagactcaatcaccagaaaaaaaggatcttaaatctttaagaagtcagacatcaagaggttctgccaagctgtctcctcagtccttcagtgtcaggctcacagatcagctgtctgctgaccaaaaacagaagagcatcagctcattgactctttcaagttgtttaattccacagtataatcaagaggcttcagttctacagaaaaaggggcataaaagaaagcatttcctaatggagaatataaataatgaaaataaaggaagcattaatcttaaaagaaaacatattacatataataatttgtcagagaaaacaagtaaacaaatggcattggaagaagatactgatgacgccgaaggctacctaaattctgggaactcaggagcattgaaaaaacatttttgtgatattaggcatttggatgattgggcaaaaagccagctgattgaaatgctcaaacaggcagcagccctggtgataactgtgatgtatactgatggttccacccagctaggagctgaccagacccccgtttcttctgttagaggaattgtggtgttagtaaaacgccaagcagagggtggccatggctgtccagatgccccggcctgtggtcctgttctggagggctttgtgtcagatgatccatgcatctacattcaaatagagcactctgctatctgggaccaagaacaggaggcacatcaacaatttgcccggaacgtgctatttcaaacaatgaaatgtaaatgtcctgttatttgttttaatgctaaggattttgtgagaatagtgctgcagttttttggcaatgatggcagttggaagcatgttgctgattttatagggctagatcccagaattgctgcatggcttatagatcctagtgatgccacaccctcttttgaagatttagtagaaaaatactgtgaaaaatccattacagttaaagtgaacagcacatatggaaattcctcaagaaatattgtgaatcagaatgtacgtgagaacctgaagacactctacagacttacaatggacctttgctctaaactgaaggattatggtttatggcaactatttcgtactttggagcttcctctgataccaattttggcagtgatggaaagccatgccattcaggtgaacaaagaggagatggagaagacgtcagcacttcttggggctcgtctcaaggaattggagcaagaagctcattttgttgcaggagaacggtttcttataacgagcaataaccagcttcgagagatcctctttggcaagttaaagctgcacctgctgagtcaaaggaacagtctccccagaacggggttgcagaaatacccgtctacatcagaagcagtgttaaatgctctgcgagaccttcatccattacccaagataattttggaatacaggcaggttcacaagatcaagtcaacctttgtagatggattactagcttgcatgaaaaagggctccatttcctctacatggaatcagactggaactgtgactggaagactttcagccaagcatcctaatatccaaggtatctccaagcacccaattcagattactacacctaagaattttaaaggtaaagaagacaagattctcacgatctccccgagggccatgtttgtttcatccaaaggccacacctttctagcagcagacttttcacagattgaattgcgcattcttacacatttatctggagatccggaacttctgaagttattccaggaatctgaaagagatgatgtattttctactctgacttcacagtggaaggatgtgcccgtggaacaggtgacacacgcagacagagagcaaaccaagaaggtggtgtacgcggtggtctatggagcagggaaggagcggctggctgcttgccttggagttcctattcaggaagctgcccagtttttggagagttttttgcagaagtacaagaaaatcaaggacttcgcccgagcagctattgcccagtgtcaccagacaggctgtgtggtgtccatcatgggcagaaggagacccctgccaaggattcacgctcatgaccagcaactccgggcacaagcagagcgacaggcagtgaacttcgtggtgcaaggctccgctgctgacctctgcaagctggccatgatccatgtcttcactgcagtggctgcttcccacaccttgacggccaggctggtggcccagatccatgatgagctgctgtttgaagtggaagatccgcagatcccggagtgtgcagctctcgtcaggaggaccatggagtccttggaacaggtgcaggcattggagctgcagcttcaggtacccctcaaggtgagcctgagtgccggccgctcatggggacacctggtgccactgcaggaggcctggggccctccgccaggcccatgtcgcactgagtctcccagcaacagcctggctgcccctgggtcccctgccagcacccagcccccacccctgcatttttcgccttcattttgtctgtagccccaggcaacagtgggaggagagaactggtttccagcagtccattgtgtggccttccccaaggtcaccagctctgtacgccccaggacgcattaaccctttggggctggggtggcccgccatcccctggagtaaatgcctgtgcaaagccctcctcatccttgtctgagtgaattcttcctgtgagtgggaagtg

SEQ ID NO: 22987 - DNA, 3331 bp, Homo sapiens
cggcggcgtaggctgtggcgggaaacgctgtttgaagcggcaggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgct

SEQ ID NO: 22988 - DNA, 3446 bp, Homo sapiens
gggagtcaggggtcacggcggcgtaggctgtggcgggaaacgctgtttgaagcgggatggatggcaagcggcggccaggcccagggcccggggtgcccccaaagcgggcccgtgggggcctctgggatgatgatgatgcacctcggccatcccaattcgaggaggacctggcactgatggaggagatggaggcagaacacaggctgcaggagcaggaggaggaggagctgcagtcagtcctggagggggttgcagacgggcaggtcccaccatcagccatagatcctcgctggcttcggcccacaccaccagcgctggacccccagacagagcccctcatcttccaacagttggagattgaccattatgtgggcccagcgcagcctgtgcctggggggcccccaccatcccgcggctccgtgcctgtgctccgcgccttcggggtcaccgatgaggggttctctgtctgctgccacatccacggcttcgctccctacttctacaccccagcgccccctggtttcgggcccgagcacatgggtgacctgcaacgggagctgaacttggccatcagccgggacagtcgcggggggagggagctgactgggccggccgtgctggctgtggaactgtgctcccgagagagcatgtttgggtaccacgggcacggcccctccccgttcctgcgcatcaccgtggcgctgccgcgcctcgtggccccggcccgccgtctcctggaacagggcatccgtgtggcaggcctgggcacgcccagcttcgcgccctacgaggccaacgtcgactttgagatccggttcatggtggacacggacatcgtcggctgcaactggctggagctcccagctgggaaatacgccctgaggctgaaggagaaggctacgcagtgccagctggaggcggacgtgctgtggtctgacgtggtcagtcacccaccggaagggccatggcagcgcattgcgcccttgcgcgtgctcagcttcgatatcgagtgcgccggccgcaaaggcatcttccctgagcctgagcgggaccctgtcatccagatctgctcgctgggcctgcgctggggggagccggagcccttcctacgcctggcgctcaccctgcggccctgtgcccccatcctgggtgccaaggtgcagagctacgagaaggaggaggacctgctgcaggcctggtccaccttcatccgtatcatggaccccgacgtgatcaccggttacaacatccagaacttcgaccttccgtacctcatctctcgggcccagaccctcaaggtacaaacattccctttcctgggccgtgtggccggcctttgctccaacatccgggactcttcattccagtccaagcagacgggccggcgggacaccaaggttgtcagcatggtgggccgcgtgcagatggacatgctgcaggtgctgctgcgggagtacaagctccgctcctacacgctcaatgccgtgagcttccacttcctgggcgagcagaaggaggacgtgcagcacagcatcatcaccgacctgcagaatgggaacgaccagacccgccgccgcctggctgtgtactgcctgaaggatgcctacctgccactgcggctgctggagcggctcatggtgctggtgaacgccgtggagatggcgagggtcactggcgtgcccctcagctacctgctcagtcgtggccagcaggtcaaggtcgtatcccagctgttgcggcaggccatgcacgaggggctgctgatgcccgtggtgaagtcagagggcggcgaggactacacgggagccactgtcatcgagcccctcaaagggtactacgacgtccccatcgccaccctggacttctcctcgctgtacccgtccatcatgatggcccacaacctgtgttacaccacgctccttcggcccgggactgcacagaaactgggcctgactgaggatcagttcatcaggacccccaccggggacgagtttgtgaagacctcagtgcggaaggggctgctgccccagatcctggagaacctgctcagtgcccggaagagggccaaggccgagctggccaaggagacagaccccctccggcgccaggtcctggatggacggcagctggcgctgaaggtgagcgccaactccgtatacggcttcactggcgcccaggtgggcaagttgccgtgcctggagatctcacagagcgtcacggggttcggacgtcagatgatcgagaaaaccaagcagctggtggagtctaagtacacagtggagaatggctacagcaccagtgccaaggtggtgtatggtgacactgactccgtcatgtgccgattcggcgtgtcctcggtggctgaggcgatggccctggggcgggaggccgcggactgggtgtcaggtcacttcccgtcgcccatccggctggagtttgagaaggtctacttcccatacctgcttatcagcaagaagcgctacgcgggcctgctcttctcctcccggcccgacgcccacgaccgcatggactgcaagggcctggaggccgtgcgcagggacaactgccccctcgtggccaacctggtcactgcctcactgcgccgcctgctcatcgaccgagaccctgagggcgcggtggctcacgcacaggacgtcatctcggacctgctgtgcaaccgcatcgatatctcccagctggtcatcaccaaggagctgacccgcgcggcctccgactatgccggcaagcaggcccacgtggagctggccgagaggatgaggaagcgggaccccgggagtgcgcccagcctgggcgaccgcgtcccctacgtgatcatcagtgccgccaagggtgtggccgcctacatgaagtcggaggacccgctgttcgtgctggagcacagcctgcccattgacacgcagtactacctggagcagcagctggccaagcccctcctgcgcatcttcgagcccatcctgggcgagggccgtgccgaggctgtgctactgcggggggaccacacgcgctgcaagacggtgctcacgggcaaggtgggcggcctcctggccttcgccaaacgccgcaactgctgcattggctgccgcacagtgctcagccaccagggagccgtgtgtgagttctgccagccccgggagtctgagctgtatcagaaggaggtatcccatctgaatgccctggaggagcgcttctcgcgcctctggacgcagtgccagcgctgccagggcagcctgcacgaggacgtcatctgcaccagccgggactgccccatcttctacatgcgcaagaaggtgcggaaggacctggaagaccaggagcagctcctgcggcgcttcggaccccctggacctgaggcctggtgaccttgcaagcatcccatggggcgggggcgggaccagggagaattaataaagttctggacttttgct

SEQ ID NO: 22989 - DNA, 2158 bp, Homo sapiens
gagtggggtccagggaaacggggtcagctgggggtggcagttccaggccgcgaggccgggctcctgggtcggtgggctggtgtcttggcggacgtcccgcagctgccgcgtggatccgagccggggcacccgccgtgactgggacagcccccagggcgctctcggccccatcccgagtagcgcggcctggctgctgccgccatcaagcacgttcgagccaaaagctcctaacgagtcactcgttagacacgtgtgcggagcctgtgtcccaggccagtgctgtcccgtggagatagattgcaagccgctagggaattttttaactttctagtgccggagagctggatggaggcagatcgggaattccatttggggcaaactgaacttgattgagaccctggtagttgtccagatggaacaggacacctgagtctagggttcgggaagaactccagatgggacaaacactcctagctttccttttctctttttggatgaccgctacaggtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctgactcaaaaaagtggttttgaccagagaggcccagatggaggctgttcattccctgcagtgtcggcattgtaaataaagcctgagcacttgctgatgcga

SEQ ID NO: 22990 - DNA, 556 bp, Homo sapiens
agtggtcggcgggatgaggcgcctggtgacggacggggcgaggagggcagcgattgtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccatt

SEQ ID NO: 22991 - DNA, 765 bp, Homo sapiens
gcggcgggaagagcccgggaagcttagtggggaagcgtctcttgatgggtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggat

SEQ ID NO: 22992 - DNA, 1659 bp, Homo sapiens
gggatgcggcgcgccgcgcgggtgagacatcggtatccaggcacgataaatttccaagtggacacaatgtctggtgtcaactacagctgttctccttcttttcccagtatcctttgggtgcagtgagacaccaggagagctgctgctttgggggatggacaggggcagcaggaatgcctttgtgttttcgcagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacggggactgtcctggctgtgtttggctccgtgagagacgacgggaagtttctggtggaggactattgctttgctgaccttgctccccagaagcccgcacccccacttgacacagataggtttgtgctactggtgtccggcctgggcctgggtggcggtggaggcgagagcctgctgggcacccagctgctggtggatgtggtgacggggcagcttggggacgaaggggagcagtgcagcgccgcccacgtctcccgggttatcctcgctggcaacctcctcagccacagcacccagagcagggattctatcaataaggccaaatacctcaccaagaaaacccaggcagccagcgtggaggctgttaagatgctggatgagatcctcctgcagctgagcgcctcagtgcccgtggacgtgatgccaggcgagtttgatcccaccaattacacgctcccccagcagcccctccacccctgcatgttcccgctggccactgcctactccacgctccagctggtcaccaacccctaccaggccaccattgatggagtcagatttttggggacatcaggacagaacgtgagtgacattttccgatacagcagcatggaggatcacttggagatcctggagtggaccctgcgggtccgtcacatcagccccacagcccctgacactctaggttgttaccccttctacaaaactgacccgttcatcttcccagagtgcccgcatgtctacttttgtggcaacacccccagctttggctccaaaatcatccgaggtcctgaggaccagacagtgctgttggtgactgtccctgacttcagtgccacgcagaccgcctgccttgtgaacctgcgcagcctggcctgccagcccatcagcttctcgggcttcggggcagaggacgatgacctgggaggcctggggctgggcccctga

SEQ ID NO: 22993 - DNA, 665 bp, Homo sapiens
cacagttggactcaccacatctcctgtacttcgtagccctaggtggctagtggcataagacacaaaaatctcagctctcctggagcttatggtctagttggagcaggcagacaatacatttaaaatatacagtttgttagaagtgaacctccttggcctgggcgaagctgtgtggaccaagcaagtcaggagtgtggccatgttttctgagcaggctgcccagagggcccacactctactgtccccaccatcagccaacaatgccacctttgcccgggtgccagtggcaacctacaccaactcctcacaacccttccggctaggagagcgcagctttagccggcagtatgcccacatttatgccacccgcctcatccaaatgagacccttcctggagaaccgggcccagcagcactggggcagtggagtgggagtgaagaagctgtgtgaactgcagcctgaggagaagtgctgtgtggtgggcactctgttcaaggccatgccgctgcagccctccatcctgcgggaggtcagcgaggagcacaacctgctcccccagcctcctcggagtaaatacatacacccagatgacgagctggtcttggaagatgaactgcagcgtatcaaactaaaaggcaccattgacgtgtcaaagctggttacgg

SEQ ID NO: 22994 - DNA, 5615 bp, Homo sapiens
ttttttttttttttttttggtggttatatacaaataggaccagtacaaatgcctgcatggggttgatgaacaccagaataagggttgtctttacttctgtgtgaggagggaataggttggggtcacacagggcttcactctaatcgtctcacaaaggaagtcagagtggccaagtgttgaagcttgatggagccgagtggatcatagtgtgcgtgtcttctttaggtctccttatgtttgcagtattcaccacagatgtttcctccagtgaaagggaagcactgacggttgccagttgctttgctagtgacatgaaaacaggctcgttttttctagaaagcagcctgagtcttctgtgtgttactcagcaaggaacatgtagacatggttatgaacgtgcacgtttgcctgtatgcatgcacgtggttactcagaaacgcagacatgtttacgcacacacgcatgtctttgcctatacgcatgcgcgtggttactcagaaacgtagacatgtttacgcacgcatgcgtttatgtatgtgcatgcacatggttatgccgtgagaaacatgtagacatagttacgaacatgcacgtgtttgcctgtacgcatgcacgtggttactcaatgagaaacgcagacatgtctacgcacacgcatgtgtttatgtatatgcatgcccatggttacgctgtgaggaacatgtagacatgtttacgtgcacacacgcacgtgtttacacatacgcacgtgttactccccgaggaacctgtaggcatgtttgtgcatacatatgcacgcagatgtatacattgatgtttgtgaacagctgttacacgtccttatttccatgttcatttgataagagttaggatcagattttgggtgattttcactgttactgagctgtgtgcctgtcttccttacccagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctgaaggaggcagacactcccaagtgtgaagagaaggaaaggaggaagagggagttgcacagctcggccacaggaaggtcttgccgaggggcatctgagcagaggctgggggacgcgccaagctgccgtgtggtggtgcacggcgttcaggcctgcaggatggagggagtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccaggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttc

SEQ ID NO: 22995 - DNA, 7840 bp, Homo sapiens
cgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccaggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttc

SEQ ID NO: 22996 - DNA, 3569 bp, Homo sapiens
cgccaaatttctcccctgaagcagaggtggtagccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaactgctggagaagaatga

SEQ ID NO: 22997 - DNA, 3001 bp, Homo sapiens
agtgttactaatagaagggtcttatcctttgcccttaatttggaaagctaaggtctaagacagggtccattgggcttcccttagtcttaatggcagagccagagaccactgtgtggcgagttttccatagtctattgtctttaccactgtgggggtccggcctggtccctggcgactgttcagtgtgctgcctctgacctccctgtggccagaggtacttcacacagagtctttctaaccagggccacttttcgatgtgaccaaaggtacatcacagggatctccagccagctctactgagtatgatgtgtgaggcatcagcacttaggtgtcaggagccgtcggtctgctgcagagggcgtggttgagggtcaggagccatcagtctgcggagagcatggttgagggcagctactcgcattacccaccagcggtggttcatgctgggcaatgcttgctgtgtaccaggaggtgggccgagcacttcgcattctgcctctgtccccacatcagcccagggacggggagcggttattgtctgtttttcagataaggaaactgaggtcagaggggctgcctttgtggtcataccacaaatgaatggaagggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccaggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttctct

SEQ ID NO: 22998 - DNA, 7829 bp, Homo sapiens
atgagccgtcccctgggcttgaaatctttcccgcggcacaaacaggcgccccttcctctgtcgctcacttttcacggttgtctccttctgaggcgggatgatggcgccacttcctcagtttcggcactcaagcgcctggaacggagtcagtggacggataagatggatttgcggtttggttttgagcggctgaaggagcctggtgagaagacaggctggctcattaacatgcatcctaccgagattttagatgaagataagcgcttaggcagtgcagtggattactactttattcaagatgacggaagcagatttaaggtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccccgggccccgggtgcctctgcgtccgtgccaggcctcctgatgccaaggccacatccccgtgcttccagtgaccagaccactgaccaccctgactgtccaaacctgtgaccccaggccagggaacggggaggaaaccaaagaaaaccattttcagggagctcagacgtcacaggagggagcgggagcaggatgtggccctggcctcgccagagcacctgaagaagcaggccgtgagcgaggctgcgagtgccctgggcgccgtttctcacgcagtgaatgcttttccaggcctctgttgcttcctgcaccacacctggtggggtgggagcgtcctctaggtgcccctagttctttgtcctgcctcccagagggaggaaaagcccctgggggcttctggctccctgagattgggctctgagacgagacgggttcccaaggccctggtggggctggagtctcacctgtttgcatggagaaatgggctggccccacagcctcacaggagcagtttgtgggctggtttccccaggaatccagaccctaacccgtgagaatctggattttggcttgtgagccctgcttatttggagccgggtctagagggaaccctctatcagcctcaggaaaacaagacctctgtgcacctcacttttggctcactgcagcccttgtccttcacctccacacaggaccagctggaagcagaaagaagaaaggccaatttcacagggcaccaaacaagtatgaaatgtaaatcagaaatgcagacaccccagacgagagcctcacaggagggagggggccccacaggctccccaggaggctcgtgtctttggcccagagccagccttagtttgtccctgccatctactgtctgaggccatcgctgctacactttgtttttatttgtatttcatactgaagtttc

SEQ ID NO: 22999 - DNA, 6800 bp, Homo sapiens
agccaacggctccatgtctctgaggagcggcgggcggcggcgcgcggacccaggcgcggatggcgaggccagcagggatgatggcgccacttcctcagtttcggcactcaagcgcctggaacggagtcagtggacggataagatggatttgcggtttggttttgagcggctgaaggagcctggtgagaagacaggctggctcattaacatgcatcctgtggctttgccctataaaccgtatttctacattgcgaccagaaagggttgtgagcgagaagtttcatcttttctctccaagaagtttcagggcaaaattgcaaaagtggagactgtccccaaagaggatctggacttgccaaatcacttggtgggtttgaagcgaaattacatcaggctgtccttccacactgtggaggatcttgtcaaagtgaggaaggagatctcccctgccgtgaagaagaacagggagcaggatcacgccagcgacgcgtacacagctctgctttccagtgttctgcagaggggcggtgtcattactgatgaagaggaaacctctaagaagatagctgaccagttggacaacattgtggacatgcgcgagtacgatgttccctaccacatccgcctctccattgacctgaagatccacgtggctcattggtacaatgtcagataccgaggaaatgcttttccggtagaaatcacccgccgagatgaccttgttgaacgacctgaccctgtggttttggcatttgacattgagacgaccaaactgcccctcaagtttcctgatgctgagacagaccagattatgatgatttcctacatgatcgatggccagggctacctcatcaccaacagggagattgtttcagaagatattgaagattttgagttcacccccaagccagaatatgaaggccccttttgtgtcttcaatgaacccgatgaggctcatctgatccaaaggtggtttgaacacgtccaggagaccaaacccaccatcatggtcacctacaacggggacttttttgactggccatttgtggaggcccgggcagcagtccacggtctgagcatgcagcaggagataggcttccagaaggacagccagggggagtacaaggcgccccagtgcatccacatggactgcctcaggtgggtgaagagggacagttaccttcctgtgggcagtcataatctcaaggcggccgccaaggccaagctaggctatgatcccgtggagctagacccggaggacatgtgccggatggccacggagcagccccagactctggccacgtattctgtgtcagatgctgtcgccacttactacctgtacatgaagtacgtccacccattcatctttgctctgtgcaccattattcccatggagcccgacgaggtgctgcggaagggctctggcactctgtgtgaggccttgctgatggtgcaggccttccacgccaacatcatcttccccaacaagcaagagcaggagttcaataagctgacggacgacggacacgtgctggactctgagacctacgtcgggggccacgtggaggccctcgagtctggggttttccgcagcgatatcccttgccggtttaggatgaatcctgccgcctttgacttcctgctgcagcgggttgagaagaccttgcgccacgcccttgaggaagaggagaaagtgcctgtggagcaagtcaccaactttgaagaggtgtgtgatgagattaagagcaagcttgcctccctgaaggacgttcccagccgcatcgagtgtccactcatctaccacctggacgtgggggccatgtaccccaacatcatcctgaccaaccgcctgcagccctctgccatggtggacgaagccacctgtgctgcctgtgacttcaataagcctggagcaaactgccagcggaagatggcctggcagtggaggggcgagttcatgccagccagtcgcagcgaataccatcggatccagcaccagctggagtcagagaagttcccccccttgttcccagaggggccagctcgggcctttcatgaactgtcccgcgaggaacaggcgaaatacgagaagagaaggctggcggattactgccggaaagcctacaagaagatccacatcaccaaggtggaagagcgtctcaccaccatctgccagcgggaaaactccttctacgtggacaccgtgcgtgccttccgggacaggcgttacgagttcaaagggctccacaaggtgtggaaaaagaagctctcggcggccgtggaggtgggcgacgcggctgaggtgaagcgctgcaagaacatggaggtgctgtatgactcgctgcagctggcccacaagtgcatcctgaactccttctatggctatgtcatgcgcaagggggctcgctggtactccatggagatggctggcatcgtctgcttcacaggggccaacatcatcacccaggcacgggagctgatcgagcagattgggaggcccttagagctggacacagatggtatatggtgcgtcctgcccaacagcttcccagaaaattttgtcttcaagacgaccaatgtgaagaagcccaaagtgaccatctcctacccaggcgccatgttgaacatcatggtcaaggaaggcttcaccaatgaccagtaccaggagctggctgagccgtcctcactcacctacgtcacccgctcagagaacagcatcttttttgaggttgatgggccctaccttgccatgattcttccagcctccaaggaagaaggcaagaaattgaagaagaggtatgctgtgttcaatgaagacggttctctggctgagctcaagggctttgaggtcaaacgccgcggggaactgcagctgattaagatcttccaatcctcggtgtttgaggccttcctcaagggcagcacgctggaagaggtgtatggctctgtagccaaggtggctgactactggctggacgtgctgtacagcaaggcagccaacatgcctgactctgagctattcgagctcatctctgagaaccgttccatgtctcggaagctggaagattacggggagcagaagtctacgtccatcagcacagcaaagcgcctggccgagttcctgggagaccagatggtcaaggatgcagggctgagttgccgctacatcatctcccgcaagcccgagggctcccctgtcacggagagggccatcccacttgccattttccaagcagagcccacggtgaggaagcactttctccggaaatggctcaagagctcttcccttcaagactttgatattcgagcaattctggattgggactactacattgagcggctgggaagcgccatccagaagatcatcaccatccctgcggccctgcagcaggtaaagaacccagtgccacgtgtcaaacaccccgactggctgcacaaaaaactgctggagaagaatgatgtctacaagcagaagaagatcagtgagctcttcaccctggagggcaggagacaggtcacgatggccgaggcctcagaagacagtccgaggccaagtgctcctgacatggaggacttcggcctcgtaaagctgcctcacccagcagcccctgtcactgtgaagaggaagcgagttctttgggagagccaggaggagtcccaggacctcacgccgactgtgccctggcaggaaatcttggggcagcctcccgccctgggaaccagccaggaggaatggcttgtctggctccggttccacaagaagaagtggcagctgcaggcccggcagcgcctcgcccgcaggaagaggcagcgtctggagtcggcagagggtgtgctcaggcccggggccatccgggatggtcctgccacggggctggggagcttcttgcgaagaactgcccgcagcatcctggaccttccgtggcagattgtgcagatcagcgagaccagccaggccggcctgttcaggctgtgggcgctcgttggcagtgacttgcactgcatcaggctgagcatcccccgtgtgttctacgtgaaccagcgagtcgctaaagcggaggagggtgcttcgtatcgcaaggtaaatcgggtccttcctcgctccaacatggtctacaatctctatgagtattcagtgccagaggacatgtaccaggaacacatcaacgagatcaacgctgagctgtcagcgccagacatcgagggcgtatatgagactcaggttccgttactgttccgggccctggtgcacctgggctgtgtgtgtgtggtcaataaacagctggtgaggcacctttcaggctgggaagcagagacctttgctcttgagcacctggagatgcgctctctggcccagttcagctacctggaaccagggagtatccgccatatctacctgtaccaccacgcacaggcccacaaagcgctcttcgggatcttcatcccctcacagcgcagggcatccgtctttgtgctggacactgtgcgcagcaaccagatgcccagccttggcgccctgtactcagcagagcacggcctcctcctggagaaggtgggccctgagctcctgccaccccccaaacacaccttcgaagttcgggcagaaactgacctgaagaccatctgcagagccatccagcgattcctgctcgcctacaaggaggagcgccgggggcccacactcatcgctgttcagtccagctgggagctgaagaggctggccagtgaaattcctgtcttggaggaattcccactggtgcctatctgtgtggctgacaagatcaactatggggtcctggactggcagcgccatggagcccggcgcatgatccgtcactacctcaacctggacacctgcctgtcgcaggccttcgagatgagcaggtactttcacattcccattgggaacctaccagaggacatctccacattcggctccgacctcttctttgcccgccacctccagcgccacaaccacctgctctggctgtcccctacagcccgccctgacctgggtggaaaggaggctgatgacaactgtcttgtcatggagttcgatgaccaagccactgttgagatcaacagttcaggctgttactccacagtgtgtgtggagctggaccttcagaacctggccgtcaacaccattctccagtctcaccatgtcaacgacatggagggggccgacagcatggggatcagcttcgacgtgatccagcaggcctccctggaggacatgatcacgggtggtcaggctgccagtgccccggccagctacgatgagacagccctgtgctctaacaccttcaggatcctgaagagcatggtcgtgggctgggtgaaggagatcacccagtaccacaacatctatgcagacaaccaggtgatgcacttctaccgctggcttcggtcgccatcctctctgcttcatgaccctgccctgcaccgcacactccacaacatgatgaagaagctcttcctgcagctcatcgctgagttcaagcgcctggggtcatcagtcatctacgccaacttcaaccgcatcatcctctgtacaaagaagcgccgtgtggaagatgccatcgcttacgtggagtacatcaccagcagcatccattcaaaggagaccttccattctctgacaatttctttctctcgatgctgggaatttcttctctggatggatccatctaactatggcggaatcaaaggaaaagtttcatctcgtattcactgtggactgcaagactcccagaaagcagggggagcagaggatgagcaggaaaatgaggacgatgaggaggaaagagatggggaggaggaggaagaggcggaggaatccaacgtggaggatttactggaaaacaactggaacattttgcagtttttgccacaggcagcctcctgccagaactacttcctcatgattgtttcagcgtacatcgtggccgtgtaccactgcatgaaggacgggctgaggcgcagtgctccagggagcacccccgtgaggaggaggggggccagccagctctcccaggaggccgagggggcggtcggagcccttcccggaatgatcaccttctctcaggattatgtcgcaaatgagctcactcagagcttcttcaccatcactcagaagattcagaagaaagtcacaggctctcggaactccactgagctctcagagatgtttcctgtcctccccggttcccacttgctgctcaataaccctgccctggagttcatcaaatacgtgtgcaaggtgctgtccctggacaccaacatcacaaaccaggtgaataagctgaaccgagacctgcttcgcctggtggatgtcggcgagttctccgaggaggcccagttccgagacccctgccgctcctacgtgcttcctgaggtcatctgccgcagctgtaacttctgccgcgacctggacctgtgtaaagactcttccttctcagaggatggggcggtcctgcctcagtggctctgctccaactgtcaggcgccctacgactcctctgccatcgagatgacgctggtggaagttctacagaagaagctgatggccttcaccctgcaggacctggtctgcctgaagtgccgcggggtgaaggagaccagcatgcctgtgtactgcagctgcgcgggagacttcgccctcaccatccacacccaggtcttcatggaacagatcggaatattccggaacattgcccagcactacggcatgtcgtacctcctggagaccctggagtggctgctgcagaagaacccacagctgggccattagccagccc

SEQ ID NO: 23000 - DNA, 1776 bp, Homo sapiens
taacagggtttagcgccacgcgggccagggccgaggccggagctgggaggggcgcgcccgggaaggggcggagctgcggcggtggcgccaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattctgatattacaataaaattatggtaaa

SEQ ID NO: 23001 - DNA, 1792 bp, Homo sapiens
agtttcccggcagcaaaggagcgcgaggtggtctccactttcagcctactcggtccggggttgcgaactgtaaggtctgagttgctgcggcgcaggcagcggagaccaagcagggatcttaacagggtttagcgccacgcgggccagggccgaggccggagctgggaggggcgcgcccgggaaggggcggagctgcggcggtggcgccaaatcgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactattctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctggctcttttccaagaagtggattttcattcaaagttttttatccttctaataagacagtagaagatagcaaacttcaaggcttttgagattcttaaagatcatctgaagaaaattcatcagttttctgcttaactctatatcttatgtgattct

SEQ ID NO: 23002 - DNA, 1581 bp, Homo sapiens
cgcaaatatggcgccggagcggctgcggagccgggcgctctccgccttcaagttgcggggcttgctgctccgtggtgaagctattaagtacctcacagaagctcttcagtctatcagtgaattagagcttgaagataaactggaaaagataattaatgcagttgagaagcaacccttgtcatcaaacatgattgaacgatctgtggtggaagcagcagtccaggaatgcagtcagtctgttgatgaaactatagagcacgttttcaatatcataggagcatttgatattccacgctttgtgtacaattcagaaagaaaaaaatttcttcctctgttaatgaccaaccaccctgcaccaaatttatttggaacaccaagagataaagcagagatgtttcgtgagcgatataccattttgcaccagaggacccacaggcatgaattatttactcctccggtgataggttctcaccctgatgaaagcggaagcaaattccagcttaaaacaatagaaaccttattgggtagtacaaccaaaatcggagatgcgattgttcttggaatgataacgcagttaaaagagggaaaattttttctggaagatcctactggaacagtccaactagaccttagtaaagctcagttccatagtggtttatacacagaggcatgctttgtcttagcagaaggttggtttgaagatcaagtgtttcatgtcaatgcctttggatttccacccactgagccctctagtactactagggcatactatggaaatattaatttttttggaggtccttctaatacatctgtgaagacttctgcaaaactaaaacagctagaagaggagaataaagatgctatgtttgtgtttttatctgatgtttggttggaccaggtggaagtattggaaaaacttcgcataatgtttgctggttattcaccagcacctccaacctgctttattctgtgtggtaatttttcatctgcaccatatggaaaaaatcaagttcaagctttgaaagattccctaaaaactttggcagatataatatgtgaatacccagatattcaccaaagtagtcgttttgtgtttgtacctggtccagaggatcctggatttggttccatcttaccaaggccaccacttgctgaaagcatcactaatgaattcagacaaagggtaccattttcagtttttactactaatccttgcagaattcagtactgtacacaggaaattactgtcttccgtgaagacttagtaaataaaatgtgcagaaactgcgtccgttttcctagcagcaatttggctattcctaatcactttgtaaagactatcttatcccaaggacatctgactcccctacctctttatgtctgcccagtgtattgggcatatgactatgctttgagagtgtatcctgtgcccgatctacttgtcattgcagacaaatatgatcctttcactacgacaaataccgaatgcctctgcataaaccctgtaagaatgtagttaatcttatatagtcattatttatcaagattagagtgcattttttaatttaaaaatatatattt

SEQ ID NO: 23003 - DNA, 2109 bp, Homo sapiens
gcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 23004 - DNA, 2191 bp, Homo sapiens
agcggcgcagggcaccatgggaaacggacggaagctccattgagccaaataagttggccacgtggggcggaacggaaacctcgcagggtcagaccgtagcgacgcgggaagtccggacgcagtagctccctgaagcggaggcgaaggggagtttaagccccagcggcggcaatggcggagaggcccgaggacctaaacctgcccaatgccgtgatcaccaggatcatcaaggaggcgctcccggacggtgtcaacatctccaaggaggcccggagcgccatctcccgcgccgccagcgtcttcgtgctgtacgccacatcctgtgctaacaactttgcaatgaaaggaaagcggaagacgctgaatgccagtgatgtgctctcagccatggaagagatggagttccagcggttcgttaccccattgaaagaagctctggaagcatataggcgggagcagaaaggcaagaaggaggcctcagagcaaaagaagaaggacaaagacaaaaaaacagactcggaagagcaagacaagagcagggatgaggacaatgatgaagacgaagaaaggctggaagaagaagaacagaatgaagaggaagaagtagacaactgaaaagggcgggagactgtggcaccttggaaggtaccacttgaaatgagacgtgctacgtgtttctgtgaagcttttccatgctgggcagagtagtctcaggcaaaagtgcctgaaaagatcagaataaaaactgactagaaataccgtcaaaaccagcacttaccaaactcagagcatctgagtagcagaatcctgttttgcttcatcaatctgaaggttatggccttttgacaagagggattctgaacgactaaattagtcagtttgctcgcttttgtttacttaaatgtatggttagatggtttttgatctgcagtcttccctagtcccccaaataagtaataataacttccatgctgcctgctgtgttccagatcacagaggcagccaaggctcaggaaaaactggggctttgcttatggtcagcctatgtttgattgcacagtctttgacaatagtagcttactaagactgctcagaatgagtaagctttaggaaactactaaaatgctgtgggagaataacaaaatccgttctctctcttcacttgacagaagcattaactgaattttgtttttcatagacccacttggcccaaaacctttctatattgcctgtagatgatcggcctgctggtgtggtagtaatctgatcacagatattcttaaatcagcagtgtggaatggtattagtcaaacatggtgccagtgtcttttacaaaaacagatggcatagtgtcagatgtaccttactctctgctactgtacagctttaggatttgtcatcacctcccggaaggtgtaaaaccccaggcttcctcttcttgtagtccatctcccagacttgtgactatggcttttcattcttcaattcatgacgagtgccaaacttgattttctctaggcacagctttctccctctgtgcctcctgcttcctttctctctcctgcctctcctctgctccccatcccactttctcatctgcctccttttctcacttctgtcagtctgtaagctttgataacctgcttaatactccaaagtgtgagttcctctgatctcttgattccttagttctaatctcacgttttgtttttaagagatggagtctctcactctgtggcccaggctggagtgcagtggcatgatcatagctcattgcatccttgaaatcctgggctcaggtgatcctcccgcctgagcctcctgagtatctgggactacagatgcgtgccaccaagcctggctaattttgtctcatgtcttctaaaaattattttgtgaagccccttcacaaaaaaccttaagggaaatctgatggtgctcaggaatctaactctccctaaaccatcctctttaactgcttctaaaatatctctgttggcctttcttagcctttttctgtttccattcagtgctccaagcgctttttgtttctaagttgagtgcttggggtttgacaggtagtgacgtgtagtttgacactgttaacttgttaaatacagtgaaaagtttgtgagtgaagaatgctgagaagattgtaatgctttgtacaaataaaagtcttgttaaaaaa

SEQ ID NO: 23005 - DNA, 3322 bp, Homo sapiens
ataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatgacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaa

SEQ ID NO: 23006 - DNA, 3540 bp, Homo sapiens
aacggcccttcgcagcgggcgcgctgtcagacctcagtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaaaaatggctactggacaggatcgagtggttgctctcgtggacatggactgtttttttgttcaagtggagcagcggcaaaatcctcatttgaggaataaaccttgtgcagttgtacagtacaaatcatggaagggtggtggaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggcatggattctaatcccactgctgacagagatgtaaaaattcatcctaccagagtttttaatctttagcatttagggaggcagtgtcataaagtaaaaagtgtgtgggccttggagtctaagagacgtggttgcaaacttagctctggttattgcaatgagggccttgaacaagtcattttcttcacattctcatctgtaaaatggagataataccttacagattattgcagattaataacaatgtattcaaattatgtaactcggccgggtacaatggctcacgcctgtaatcctaacactttgggaggccgaggcagacagatcacctgaggtcaggagtttgagaccagcctggccaacatggcaaaaccatctctactaaaaatagaaaaattagccaggcacgttccaggcacctgtgatcccagctacttagaggctgaggcagaagaattgctttaaccttggaggcggaggttgcattgagctgagatcatgctagtgcgctccagcctgggcaacagagcgagacttcatctcagaaaataaaaaataggggccaggcacagtggctcatacctgtaatgccagcactttgggaggccaaggcgggcagatcacgaggtcaggagtttcagaccaatatggtgaaaccccatctctactaaaattacaaaaaaaattatccaggcgtggtggtgcacgcctgtaatcccagctactcaggaggctaaggcaggagaatcacttgaacccaggaggcagaggttggagtgagctgagatcgcgccaccgcactccagcctgggcaacagagcgagactccatctcaaacaaaaacaagaacaaaaacaaacataaagttggcacagaaaagggaccaagtttaaaaaagggttttaaatgtaatgagacttgcatagttaaaaaaaaaaaa

SEQ ID NO: 23007 - DNA, 331 bp, Homo sapiens
agtaggcaccgaacccagcattttcggcaaccgctgctggcagttttgccaggtgtttgttaccttgaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaagg

SEQ ID NO: 23008 - DNA, 2548 bp, Homo sapiens
agtctggcggctgcattgctgggcgcgccgctctcgtctgatccctgctggggacggttgcccgggcaggatcctttacgatcccttctcggtttctccgtcgtcacagggaataaatctcgctcgaaactcactggaccgctcctagaaaggcgaaaagatattcaggagcccttccattttccttccagtaggcaccgaacccagcattttcggcaaccgctgctggcagttttgccaggtgtttgttaccttgaataattgcagtgagttatgaagctcgtgcatttggagtcactagaagtatgtgggcagatgatgctaagaagttatgtccagatcttctactggcacaagttcgtgagtcccgtgggaaagctaacctcaccaagtaccgggaagccagtgttgaagtgatggagataatgtctcgttttgctgtgattgaacgtgccagcattgatgaggcttacgtagatctgaccagtgctgtacaagagagactacaaaagctacaaggtcagcctatctcggcagacttgttgccaagcacttacattgaagggttgccccaaggccctacaacggcagaagagactgttcagaaagaggggatgcgaaaacaaggcttatttcaatggctcgattctcttcagattgataacctcacctctccagacctgcagctcaccgtgggagcagtgattgtggaggaaatgagagcagccatagagagggagactggttttcagtgttcagctggaatttcacacaataaggtcctggcaaaactggcctgtggactaaacaagcccaaccgccaaaccctggtttcacatgggtcagtcccacagctcttcagccaaatgcccattcgcaaaatccgtagtcttggaggaaagctaggggcctctgtcattgagatcctagggatagaatacatgggtgaactgacccagttcactgaatcccagctccagagtcattttggggagaagaatgggtcttggctatatgccatgtgccgagggattgaacatgatccagttaaacccaggcaactacccaaaaccattggctgtagtaagaacttcccaggaaaaacagctcttgctactcgggaacaggtacaatggtggctgttgcaattagcccaggaactagaggagagactgactaaagaccgaaatgataatgacagggtagccacccagctggttgtgagcattcgtgtacaaggagacaaacgcctcagcagcctgcgccgctgctgtgcccttacccgctatgatgctcacaagatgagccatgatgcatttactgtcatcaagaactgtaatacttctggaatccagacagaatggtctcctcctctcacaatgcttttcctctgtgctacaaaattttctgcctctgccccttcatcttctacagacatcaccagcttcttgagcagtgacccaagttctctgccaaaggtgccagttaccagctcagaagctaagacccagggaagtggcccagcggtgacagccactaagaaagcaaccacgtctctggaatcattcttccaaaaagctgcagaaaggcagaaagttaaagaagcttcgctttcatctcttactgctcccactcaggctcccatgagcaattcaccatccaagccctcattaccttttcaaaccagtcaaagtacaggaactgagcccttctttaagcagaaaagtctgcttctaaagcagaaacagcttaataattcttcagtttcttccccccaacaaaacccatggtccaactgtaaagcattaccaaactctttaccaacagagtatccagggtgtgtccctgtttgtgaaggggtgtcgaagctagaagaatcctctaaagcaactcctgcagagatggatttggcccacaacagccaaagcatgcacgcctcttcagcttccaaatctgtgctggaggtgactcagaaagcaaccccaaatccaagtcttctagctgctgaggaccaagtgccctgtgagaagtgtggctccctggtaccggtatgggatatgccagaacacatggactatcattttgcattggagttgcagaaatcctttttgcagccccactcttcaaacccccaggttgtttctgccgtatctcatcaaggcaaaagaaatcccaagagccctttggcctgcactaataaacgccccaggcctgagggcatgcaaacattggaatcattttttaagccattaacacattagtgctgccctcaggcttgcctgtaggatttaatattttttatctttacagatctttatctttaatattttatctttacagatttccctgagaaagggaattatgaaatttttaatacaaaaaataatccatttaggtgctgagttacggtcccatctcttcacaggctggtcttgaactcttgatctcaagtgatccacccgccctggcctcccaaagtgctgggattacaggcctgagccaccaggccagccccaacttctactttttattttatttataaattggg

SEQ ID NO: 23009 - DNA, 4502 bp, Homo sapiens
gtagccgcgggacctagctgggtgcagacgggaagttgcggctgccagcgaagcggaccggccgggtggaggccacacgctaccccgaggctgcgtaggccgcgcgaagggggacgccgtgccgtgggcctggggtcgggggagcagcagaccgggaagcaccgtgaggaccgaggatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaagactctatcttctcatc

SEQ ID NO: 23010 - DNA, 4487 bp, Homo sapiens
cgcttgcctctcgggtagccgcgggacctagctgggtgcagacgggaagttgcggctgccagcgaagcggaccggccgggtggaggccacacgctaccccgaggctgcgtaggccgcgcgaagggggacgccgtgccgtgggcctggggtcgggggagcagcagaccgggaagcaccgatttggggtggaaggcaggcatggtcaaacccatttcactgacaggagagcagagacaggacgtgtctctctccacgtcttccagccagtaaaagaagccaagctggagcccaaagccaggtgttctgactcccagcgtgggggtccctgcaccaaccatgagccgcctgctctggaggaaggtggccggcgccaccgtcgggccagggccggttccagctccggggcgctgggtctccagctccgtccccgcgtccgaccccagcgacgggcagcggcggcggcagcagcagcagcagcagcagcagcagcagcaacagcagcctcagcagccgcaagtgctatcctcggagggcgggcagctgcggcacaacccattggacatccagatgctctcgagagggctgcacgagcaaatcttcgggcaaggaggggagatgcctggcgaggccgcggtgcgccgcagcgtcgagcacctgcagaagcacgggctctgggggcagccagccgtgcccttgcccgacgtggagctgcgcctgccgcccctctacggggacaacctggaccagcacttccgcctcctggcccagaagcagagcctgccctacctggaggcggccaacttgctgttgcaggcccagctgcccccgaagcccccggcttgggcctgggcggagggctggacccggtacggccccgagggggaggccgtacccgtggccatccccgaggagcgggccctggtgttcgacgtggaggtctgcttggcagagggaacttgccccacattggcggtggccatatccccctcggcctggtattcctggtgcagccagcggctggtggaagagcgttactcttggaccagccagctgtcgccggctgacctcatccccctggaggtccctactggtgccagcagccccacccagagagactggcaggagcagttagtggtggggcacaatgtttcctttgaccgagctcatatcagggagcagtacctgatccagggttcccgcatgcgtttcctggacaccatgagcatgcacatggccatctcagggctaagcagcttccagcgcagtctgtggatagcagccaagcagggcaaacacaaggtccagccccccacaaagcaaggccagaagtcccagaggaaagccagaagaggcccagcgatctcatcctgggactggctggacatcagcagtgtcaacagtctggcagaggtgcacagactttatgtaggggggcctcccttagagaaggagcctcgagaactgtttgtgaagggcaccatgaaggacattcgtgagaacttccaggacctgatgcagtactgtgcccaggacgtgtgggccacccatgaggttttccagcagcagctaccgctcttcttggagaggtgtccccacccagtgactctggccggcatgctggagatgggtgtctcctacctgcctgtcaaccagaactgggagcgttacctggcagaggcacagggcacttatgaggagctccagcgggagatgaagaagtcgttgatggatctggccaatgatgcctgccagctgctctcaggagagaggtacaaagaagacccctggctctgggacctggagtgggacctgcaagaatttaagcagaagaaagctaagaaggtgaagaaggaaccagccacagccagcaagttgcccatcgagggggctggggcccctggtgatcccatggatcaggaagacctcggcccctgcagtgaggaggaggagtttcaacaagatgtcatggcccgcgcctgcttgcagaagctgaaggggaccacagagctcctgcccaagcggccccagcaccttcctggacaccctggatggtaccggaagctctgcccccggctagacgaccctgcatggaccccgggccccagcctcctcagcctgcagatgcgggtcacacctaaactcatggcacttacctgggatggcttccctctgcactactcagagcgtcatggctggggctacttggtgcctgggcggcgggacaacctggccaagctgccgacaggtaccaccctggagtcagctggggtggtctgcccctacagagccatcgagtccctgtacaggaagcactgtctcgaacaggggaagcagcagctgatgccccaggaggccggcctggcggaggagttcctgctcactgacaatagtgccatatggcaaacggtagaagaactggattacttagaagtggaggctgaggccaagatggagaacttgcgagctgcagtgccaggtcaacccctagctctgactgcccgtggtggccccaaggacacccagcccagctatcaccatggcaatggaccttacaacgacgtggacatccctggctgctggtttttcaagctgcctcacaaggatggtaatagctgtaatgtgggaagcccctttgccaaggacttcctgcccaagatggaggatggcaccctgcaggctggcccaggaggtgccagtgggccccgtgctctggaaatcaacaaaatgatttctttctggaggaacgcccataaacgtatcagctcccagatggtggtgtggctgcccaggtcagctctgccccgtgctgtgatcaggcaccccgactatgatgaggaaggcctctatggggccatcctgccccaagtggtgactgccggcaccatcactcgccgggctgtggagcccacatggctcaccgccagcaatgcccggcctgaccgagtaggcagtgagttgaaagccatggtgcaggccccacctggctacacccttgtgggtgctgatgtggactcccaagagctgtggattgcagctgtgcttggagacgcccactttgccggcatgcatggctgcacagcctttgggtggatgacactgcagggcaggaagagcaggggcactgatctacacagtaagacagccactactgtgggcatcagccgtgagcatgccaaaatcttcaactacggccgcatctatggtgctgggcagccctttgctgagcgcttactaatgcagtttaaccaccggctcacacagcaggaggcagctgagaaggcccagcagatgtacgctgccaccaagggcctccgctggtatcggctgtcggatgagggcgagtggctggtgagggagttgaacctcccagtggacaggactgagggtggctggatttccctgcaggatctgcgcaaggtccagagagaaactgcaaggaagtcacagtggaagaagtgggaggtggttgctgaacgggcatggaaggggggcacagagtcagaaatgttcaataagcttgagagcattgctacgtctgacataccacgtaccccggtgctgggctgctgcatcagccgagccctggagccctcggctgtccaggaagagtttatgaccagccgtgtgaattgggtggtacagagctctgctgttgactacttacacctcatgcttgtggccatgaagtggctgtttgaagagtttgccatagatgggcgcttctgcatcagcatccatgacgaggttcgctacctggtgcgggaggaggaccgctaccgcgctgccctggccttgcagatcaccaacctcttgaccaggtgcatgtttgcctacaagctgggtctgaatgacttgccccagtcagtcgcctttttcagtgcagtcgatattgaccggtgcctcaggaaggaagtgaccatggattgtaaaaccccttccaacccaactgggatggaaaggagatacgggattccccagggtgaagcgctggatatttaccagataattgaactcaccaaaggctccttggaaaaacgaagccagcctggaccatagcactgcctggaggctctgtatttgctcccgtggagcttcatcggggtggtgcaggctcccaaactcaggctttcagctgtgctttttgcaaaagggcttgcctaaggccagccatttttcagtagcaggacctgccaagaagattccttctaactgaaggtgcagttgaattcagtgggttcagaaccaagatgccaacatcggtgtggactacaggacaaggggcattgttgcttgttgggtaaaaatgaagcagaagccccaaagttcacattaactcaggcatttcatttattttttccttttcttcttggctggttctttgttctgtcccccatgctctgatgcagtgccctagaaggggaaagaattaatgctctaacgtgataaacctgctccaaggcagtggaaataaaaagaaggaaaaaaaa

SEQ ID NO: 23011 - DNA, 1592 bp, Homo sapiens
gcctgcgccgtggcctctccggattctgttaacggtagtggtggcttgttgggatccgttgagtgatgggagagtgtgctctttaacttcggagagagatgcgctctcgtgtagccgtcagggcctgccataaggtctgcaggtgcctgttgtctgggtttgggggtcgagtagatgcggggcagccggagctgttgacggaaaggagtagccccaaaggagggcatgtgaagtcgcacgcggagctcgaggggaacggcgagcacccagaagcccccgggtctggagagggaagcgaggcgctgttagagatctgtcagagaaggcatttcctaagtggaagcaagcagcagcttagccgggattctcttctgagtgggtgccaccccggcttcggacccttgggcgtagagttgcggaagaacctggccgcagaatggtggacctcggtggtggtgttcagggagcaggtattcccggtggacgccctccaccacaaaccaggccctttgctacccggggacagtgccttcaggttagtttctgcagaaactctacgcgaaatcttgcaagacaaagagctgagtaaggaacagctagtagcatttcttgagaacgtattaaaaacttctgggaaactacgggagaaccttcttcacggtgccttggaacactatgttaattgcctggatctggtaaacaagaggctaccttatggccttgctcagattggagtgtgttttcatcctgtttttgacactaagcagatacgaaatggtgttaaaagtattggtgagaagactgaagcttcgttagtatggtttactcctccgagaacttcaaaccagtggcttgatttctggttacgtcatcgactccagtggtggagaaagtttgccatgagtccatctaacttcagcagcagtgactgtcaggatgaagaaggccggaaaggaaacaaactttactacaattttccctggggaaaggagttaatagaaaccctgtggaacctaggagatcacgaacttttacacatgtatcctggcaatgtgtctaaattacatggccgagatggacgaaaaaatgtggttccttgtgttctctctgtaaatggggacctagaccgaggcatgctggcctacctctatgattctttccagctgacagagaactcctttacaagaaagaaaaatcttcatagaaaggtacttaaacttcacccttgtttagcccctattaaggttgctttggatgtaggaagaggccccacattggaactaagacaggtttgtcaagggctatttaatgagttactagaaaatgggatttctgtgtggcctggttatttggaaactatgcagtcctcattggaacaactttattcgaagtatgatgaaatgagtattctcttcacagttttggttactgaaactactttggagaatggattaatacatctgagaagcagagacaccacaatgaaggaaatgatgcatatatccaaattaaaagactttttgattaagtatatatcatcagctaagaatgtatagatttttatatttgtataataaatattcttctctcct

SEQ ID NO: 23012 - DNA, 8775 bp, Homo sapiens
gggcgggccgggaggtttgagtttgaagactggcgggaagatgtccgcagctgttgccaggccagggttctcccgagagggaggacgctgggactgtggcttgccctgatcggccgagaagagtttgccatgaatcttctgcgtcggagtgggaaacggcggcgttcagaatcaggctcagattcgttctcgggaagcggcggtgacagcagtgccagcccccagttcctctccgggtccgtgctgagcccgccgcccggccttggtcgctgcctgaaggccgcagctgcaggagaatgcaagcctacagttcctgactacgaaagagacaagctactattggcaaactggggacttcctaaagcagttctggaaaaataccacagttttggtgtaaaaaagatgtttgaatggcaggcagagtgccttttgcttggacaagtcctggaaggaaagaatttagtttattcagctcctacaagtgctgggaagactcttgtggcagaattacttattttgaagcgggttttggaaatgcggaagaaagctttgtttattcttccctttgtttctgtggctaaagagaagaaatactacctccagagtctgtttcaggaagtaggaataaaagtagacggttatatgggcagcacctctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgtcaggcagatctagccagttctctgtctaatgctgtgcaaatcgttggcatgagtgctacccttcctaatttggagcttgtggcttcctggttgaatgctgaactctaccataccgactttcgccctgtaccgcttttggagtcagtaaaagttggaaattccatatatgactcttcaatgaaacttgtgagggaatttgagcccatgctacaagtgaagggagatgaggaccatgttgttagtttatgttatgagacgatttgtgataaccattcagtattacttttttgtccatcaaagaaatggtgtgagaagctggcagatatcattgctcgagagttttataatctacatcatcaagctgagggattggtgaaaccctctgaatgcccaccagtaattctggaacaaaaagaactcctggaagtgatggatcagttaagacgtttgccttcaggactggactctgtattacagaaaactgtaccatggggagtagcatttcatcatgcaggtcttacttttgaggagagggatatcattgaaggagcctttcgtcaaggtctcattcgggtcttggcggcaacttctactctttcttctggggtgaatttacctgcacgtcgtgtgattattcgaacccctatttttggtggtcgacctctagatattcttacttataagcagatggttggccgtgctggcaggaaaggagtggacacagtaggcgagagtatcttaatttgtaagaactctgagaaatcaaaaggcatagctctccttcagggttctctaaagcctgttcgcagctgtctgcaaagacgagaaggagaagaagtaactggcagcatgatacgagctattctggagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggaaaggtgtatcatccaacacatcttggttcggccactctttcttcttcactttctccagctgatactttagatatttttgctgacctgcaaagagcaatgaagggctttgttttagagaatgatcttcatattctctatctggttacacctatgtttgaggattggactactattgattggtatcgatttttctgtttatgggagaagttgccaacttcaatgaaaagggtggcagagctagtgggagttgaagaggggttcttggcccgttgtgtgaaaggaaaagtagtagccagaactgagagacagcatcgacaaatggccatccataaaaggtttttcaccagtcttgtgctattagatttaatcagtgaagttcccttaagggaaataaatcagaaatatggatgcaatcgtgggcagattcaatctttgcaacagtcagctgctgtttatgcagggatgattacagtattttccaaccgtctgggctggcacaacatggaactactactttcccaatttcagaagcgtcttacgtttggcatccagagggagctgtgtgacctggttcgggtatccttactaaatgctcagagagccagggttctctatgcttctggctttcatactgtggcagaccttgctagagcaaatattgtggaggtggaggtgattctgaaaaatgctgtgcctttcaaaagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaacaaaaaaggcacctttgaatttcaattcagaaaagatgagcagaagttttcgatcttggaaacgtagaaagcatctaaagcgatctagggacagcagccccctgaaagactctggagcgtgtagaatccatttacaaggacagactctgtctaatcctagtctttgtgaagacccgtttaccttagatgagaagaaaacggaatttagaaattcagggccatttgctaaaaatgtatctttgagtggtaaggaaaaagataataaaacatcattcccattacaaataaagcaaaattgttcatggaacataacactaactaatgataattttgtggagcatattgtcacaggatctcagagtaaaaatgtgacttgtcaggccactagtgtggttagtgaaaagggcagaggagtagctgttgaggcagaaaaaataaatgaagtgctgatacaaaatggttcaaaaaaccagaatgtttatatgaaacaccatgacatccatccaattaaccagtacctgcgaaagcaatctcatgaacagacaagcactattaccaaacagaaaaatataatagagagacaaatgccctgtgaagcagtcagtagttacataaatagagactcaaatgttactatcaattgtgaaaggataaagcttaatacagaggaaaataaaccaagtcattttcaggcattaggagatgatataagcagaactgtgatacccagtgaagtacttccatcagctggagcatttagcaaatcagaaggccagcatgagaattttctaaatatttctagactacaagaaaaaacaggtacttatacaacaaacaaaactaaaaataatcatgtttctgacttaggtttagtcctctgtgattttgaagatagtttctatctggatactcagtcagagaaaataatacaacagatggcaactgaaaatgccaaactaggagcaaaggacaccaacctggcagcagggataatgcagaagagcttagtccaacagaactcaatgaactcttttcagaaggagtgtcacattccttttcctgctgaacagcaccctctaggagcgactaagatagatcatttggaccttaagactgtaggtactatgaaacaaagcagtgattcacatggggttgatatcctgactccagaaagcccgattttccattctccaatactattggaggaaaatggtctttttttaaaaaagaatgaagtttctgttactgattcacaattaaatagttttcttcaaggttatcaaacacaagaaactgtgaaaccagttatacttctgattcctcaaaagagaactcccactggtgtagaaggagaatgtcttccagttcctgaaacaagtttgaatatgagtgatagtttactatttgatagcttcagtgatgactatctagtaaaagaacaattacctgatatgcaaatgaaagaaccccttccttcagaagtaacatcaaaccattttagtgattctctgtgtctacaagaagacctaattaaaaaatcaaatgtaaatgagaatcaagatacccaccagcagttgacttgttccaatgatgaatctattatattttcagaaatggattctgttcagatggttgaagctttggacaatgtggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaagctagctcacctcaggaaattcctattagagatgatggatttcccattaaaggttgtgatgacaccttggtggttggactggcagtatgctggggtggaagggatgcctattatttttcactgcagaaggaacaaaagcattctgaaattagtgccagtttggttccaccttctttagatccaagcctgactttgaaagacaggatgtggtaccttcaatcttgcttgcgaaaggaatctgataaagaatgttctgttgtcatctatgacttcatccagagctataaaattcttcttctttcttgtggcatctccttggagcaaagttatgaagatcctaaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgcagacagaggaatgccattttcaattagcatgcgacatgcctttgtgcctttcccaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccaaacaggattgtcacgaaagagaaaactgcaagggatgttctgcccaatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaa

SEQ ID NO: 23013 - DNA, 9049 bp, Homo sapiens
atgaatggtcaccgttttacgttcagaactcgttcgcttctacctttacaaaagggacaacacagatgcattactaagctcttggctcataacgatccctggggtatattcagagccccttcctcgcggcgttcatatagtgtctcaggggtctgtcagccagcaatccccaattcctcattacatattcctcacaatgcatgctggctaaaatggaaattgtgttcagaaatagccctgccctaccatcatatactaggagaaaggaggaaattatgctctattaggaggtttgagtttgaagactggcgggaagatgtccgcagctgttgccaggccagggttctcccgagagggaggacgctgggactgtggcttgccctgatcggccgagaagagtttgccatgaatcttctgcgtcggagtgggaaacggcggcgttcagaatcaggctcagattcgttctcgggaagcggcggtgacagcagtgccagcccccagttcctctccgggtccgtgctgagcccgccgcccggccttggtcgctgcctgaaggccgcagctgcaggagaatgcaagcctacagttcctgactacgaaagagacaagctactattggcaaactggggacttcctaaagcagttctggaaaaataccacagttttggtgtaaaaaagatgtttgaatggcaggcagagtgccttttgcttggacaagtcctggaaggaaagaatttagtttattcagctcctacaagtgctgggaagactcttgtggcagaattacttattttgaagcgggttttggaaatgcggaagaaagctttgtttattcttccctttgtttctgtggctaaagagaagaaatactacctccagagtctgtttcaggaagtaggaataaaagtagacggttatatgggcagcacctctccatcaaggcatttctcttcattggatattgcagtctgcacaattgagagagccaatggtctgatcaatcgcctcatagaggaaaataagatggatctgttaggaatggtggttgtggatgaattacatatgctgggagactctcaccgagggtatctgctggaacttttgctgaccaagatttgctatattactcggaaatcagcatcttgtcaggcagatctagccagttctctgtctaatgctgtgcaaatcgttggcatgagtgctacccttcctaatttggagcttgtggcttcctggttgaatgctgaactctaccataccgactttcgccctgtaccgcttttggagtcagtaaaagttggaaattccatatatgactcttcaatgaaacttgtgagggaatttgagcccatgctacaagtgaagggagatgaggaccatgttgttagtttatgttatgagacgatttgtgataaccattcagtattacttttttgtccatcaaagaaatggtgtgagaagctggcagatatcattgctcgagagttttataatctacatcatcaagctgagggtgagggattggtgaaaccctctgaatgcccaccagtaattctggaacaaaaagaactcctggaagtgatggatcagttaagacgtttgccttcaggactggactctgtattacagaaaactgtaccatggggagtagcatttcatcatgcaggtcttacttttgaggagagggatatcattgaaggagcctttcgtcaaggtctcattcgggtcttggcggcaacttctactctttcttctggggtgaatttacctgcacgtcgtgtgattattcgaacccctatttttggtggtcgacctctagatattcttacttataagcagatggttggccgtgctggcaggaaaggagtggacacagtagagagtatcttaatttgtaagaactctgagaaatcaaaaggcatagctctccttcagggttctctaaagcctgttcgcagctgtctgcaaagacgagaaggagaagaagtaactggcagcatgatacgagctattctggagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggaaaggtgtatcatccaacacatcttggttcggccactctttcttcttcactttctccagctgatactttagatatttttgctgacctgcaaagagcaatgaagggctttgttttagagaatgatcttcatattctctatctggttacacctatgtttgaggattggactactattgattggtatcgatttttctgtttatgggagaagttgccaacttcaatgaaaagggtggcagagctagtgggagttgaagaggggttcttggcccgttgtgtgaaaggaaaagtagtagccagaactgagagacagcatcgacaaatggccatccataaaaggtttttcaccagtcttgtgctattagatttaatcagtgaagttcccttaagggaaataaatcagaaatatggatgcaatcgtgggcagattcaatctttgcaacagtcagctgctgtttatgcagggatgattacagtattttccaaccgtctgggctggcacaacatggaactactactttcccaatttcagaagcgtcttacgtttggcatccagagggagctgtgtgacctggttcgggtatccttactaaatgctcagagagccagggttctctatgcttctggctttcatactgtggcagaccttgctagagcaaatattgtggaggtggaggtgattctgaaaaatgctgtgcctttcaaaagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaacaaaaaaggcacctttgaatttcaattcagaaaagatgagcagaagttttcgatcttggaaacgtagaaagcatctaaagcgatctagggacagcagccccctgaaagactctggagcgtgtagaatccatttacaaggacagactctgtctaatcctagtctttgtgaagacccgtttaccttagatgagaagaaaacggaatttagaaattcagggccatttgctaaaaatgtatctttgagtggtaaggaaaaagataataaaacatcattcccattacaaataaagcaaaattgttcatggaacataacactaactaatgataattttgtggagcatattgtcacaggatctcagagtaaaaatgtgacttgtcaggccactagtgtggttagtgaaaagggcagaggagtagctgttgaggcagaaaaaataaatgaagtgctgatacaaaatggttcaaaaaaccagaatgtttatatgaaacaccatgacatccatccaattaaccagtacctgcgaaagcaatctcatgaacagacaagcactattaccaaacagaaaaatataatagagagacaaatgccctgtgaagcagtcagtagttacataaatagagactcaaatgttactatcaattgtgaaaggataaagcttaatacagaggaaaataaaccaagtcattttcaggcattaggagatgatataagcagaactgtgatacccagtgaagtacttccatcagctggagcatttagcaaatcagaaggccagcatgagaattttctaaatatttctagactacaagaaaaaacaggtacttatacaacaaacaaaactaaaaataatcatgtttctgacttaggtttagtcctctgtgattttgaagatagtttctatctggatactcagtcagagaaaataatacaacagatggcaactgaaaatgccaaactaggagcaaaggacaccaacctggcagcagggataatgcagaagagcttagtccaacagaactcaatgaactcttttcagaaggagtgtcacattccttttcctgctgaacagcaccctctaggagcgactaagatagatcatttggaccttaagactgtaggtactatgaaacaaagcagtgattcacatggggttgatatcctgactccagaaagcccgattttccattctccaatactattggaggaaaatggtctttttttaaaaaagaatgaagtttctgttactgattcacaattaaatagttttcttcaaggttatcaaacacaagaaactgtgaaaccagttatacttctgattcctcaaaagagaactcccactggtgtagaaggagaatgtcttccagttcctgaaacaagtttgaatatgagtgatagtttactatttgatagcttcagtgatgactatctagtaaaagaacaattacctgatatgcaaatgaaagaaccccttccttcagaagtaacatcaaaccattttagtgattctctgtgtctacaagaagacctaattaaaaaatcaaatgtaaatgagaatcaagatacccaccagcagttgacttgttccaatgatgaatctattatattttcagaaatggattctgttcagatggttgaagctttggacaatgtggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaagctagctcacctcaggaaattcctattagagatgatggatttcccattaaaggttgtgatgacaccttggtggttggactggcagtatgctggggtggaagggatgcctattatttttcactgcagaaggaacaaaagcattctgaaattagtgccagtttggttccaccttctttagatccaagcctgactttgaaagacaggatgtggtaccttcaatcttgcttgcgaaaggaatctgataaagaatgttctgttgtcatctatgacttcatccagagctataaaattcttcttctttcttgtggcatctccttggagcaaagttatgaagatcctaaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgcagacagaggaatgccattttcaattagcatgcgacatgcctttgtgcctttcccaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccaaacaggattgtcacgaaagagaaaactgcaagggatgttctgcccaatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatg

SEQ ID NO: 23014 - DNA, 7519 bp, Homo sapiens
atgcccaccagtaattctcaaaaagaactcctggaagtgatggatcagttaagacgtttgccttcaggactggactctgtattacagaaaactgtaccatggggagtagcatttcatcatgcaggtcttacttttgaggagagggatatcattgaaggagcctttcgtcaaggtctcattcgggtcttggcggcaacttctactctttcttctggggtgaatttacctgcacgtcgtgtgattattcgaacccctatttttggtggtcgacctctagatattcttacttataagcagatggttggccgtgctggcaggaaaggagtggacacagtaggcgagagtatcttaatttgtaagaactctgagaaatcaaaaggcatagctctccttcagggttctctaaagcctgttcgcagctgtctgcaaagacgagaaggagaagaagtaactggcagcatgatacgagctattctggagataatagttggtggagtggcaagtacatcacaagatatgcatacttatgctgcctgcacatttttggctgcaagtatgaaagaagggaagcaaggaattcagagaaatcaagagtctgttcagcttggagcgattgaggcctgtgtgatgtggctactagaaaatgaattcatccagagtacagaagccagtgatggaacagaaggaaaggtgtatcatccaacacatcttggttcggccactctttcttcttcactttctccagctgatactttagatatttttgctgacctgcaaagagcaatgaagggctttgttttagagaatgatcttcatattctctatctggttacacctatgtttgaggattggactactattgattggtatcgatttttctgtttatgggagaagttgccaacttcaatgaaaagggtggcagagctagtgggagttgaagaggggttcttggcccgttgtgtgaaaggaaaagtagtagccagaactgagagacagcatcgacaaatggccatccataaaaggtttttcaccagtcttgtgctattagatttaatcagtgaagttcccttaagggaaataaatcagaaatatggatgcaatcgtgggcagattcaatctttgcaacagtcagctgctgtttatgcagggatgattacagtattttccaaccgtctgggctggcacaacatggaactactactttcccaatttcagaagcgtcttacgtttggcatccagagggagctgtgtgacctggttcgggtatccttactaaatgctcagagagccagggttctctatgcttctggctttcatactgtggcagaccttgctagagcaaatattgtggaggtggaggtgattctgaaaaatgctgtgcctttcaaaagtgcccggaaggcagtggatgaggaagaggaagcagttgaagaacgtcgcaatatgcgaactatctgggtgactggcagaaaaggtttaactgaaagggaagcagcagcccttatagtggaagaagccagaatgattctgcagcaggacttagttgaaatgggagtgcaatggaatccatgtgccctgttacattctagtacatgctcattgactcatagtgagtccgaagtaaaggaacacacatttatatcccaaactaagagttcttataaaaaattaacatcaaagaacaaaagtaacacaatatttagtgattcttatattaagcattcaccaaatatagtgcaagacttaaataaaagtagagagcatacaagttcctttaattgtaatttccagaatgggaatcaagaacatcagacatgttccattttcagagcaagaaaacgggcctctttagatataaataaagagaagccaggagcctctcagaatgaggggaaaacaagtgataagaaagttgttcagactttttcacagaaaacaaaaaaggcacctttgaatttcaattcagaaaagatgagcagaagttttcgatcttggaaacgtagaaagcatctaaagcgatctagggacagcagccccctgaaagactctggagcgtgtagaatccatttacaaggacagactctgtctaatcctagtctttgtgaagacccgtttaccttagatgagaagaaaacggaatttagaaattcagggccatttgctaaaaatgtatctttgagtggtaaggaaaaagataataaaacatcattcccattacaaataaagcaaaattgttcatggaacataacactaactaatgataattttgtggagcatattgtcacaggatctcagagtaaaaatgtgacttgtcaggccactagtgtggttagtgaaaagggcagaggagtagctgttgaggcagaaaaaataaatgaagtgctgatacaaaatggttcaaaaaaccagaatgtttatatgaaacaccatgacatccatccaattaaccagtacctgcgaaagcaatctcatgaacagacaagcactattaccaaacagaaaaatataatagagagacaaatgccctgtgaagcagtcagtagttacataaatagagactcaaatgttactatcaattgtgaaaggataaagcttaatacagaggaaaataaaccaagtcattttcaggcattaggagatgatataagcagaactgtgatacccagtgaagtacttccatcagctggagcatttagcaaatcagaaggccagcatgagaattttctaaatatttctagactacaagaaaaaacaggtacttatacaacaaacaaaactaaaaataatcatgtttctgacttaggtttagtcctctgtgattttgaagatagtttctatctggatactcagtcagagaaaataatacaacagatggcaactgaaaatgccaaactaggagcaaaggacaccaacctggcagcagggataatgcagaagagcttagtccaacagaactcaatgaactcttttcagaaggagtgtcacattccttttcctgctgaacagcaccctctaggagcgactaagatagatcatttggaccttaagactgtaggtactatgaaacaaagcagtgattcacatggggttgatatcctgactccagaaagcccgattttccattctccaatactattggaggaaaatggtctttttttaaaaaagaatgaagtttctgttactgattcacaattaaatagttttcttcaaggttatcaaacacaagaaactgtgaaaccagttatacttctgattcctcaaaagagaactcccactggtgtagaaggagaatgtcttccagttcctgaaacaagtttgaatatgagtgatagtttactatttgatagcttcagtgatgactatctagtaaaagaacaattacctgatatgcaaatgaaagaaccccttccttcagaagtaacatcaaaccattttagtgattctctgtgtctacaagaagacctaattaaaaaatcaaatgtaaatgagaatcaagatacccaccagcagttgacttgttccaatgatgaatctattatattttcagaaatggattctgttcagatggttgaagctttggacaatgtggatatatttcctgtccaagagaagaatcatactgtagtatctcctagagcattagaactaagtgatccagtacttgatgagcaccaccaaggtgatcaagatggaggagatcaagatgaaagggctgaaaaatcaaaattaactgggaccaggcaaaatcattcattcatatggtcaggggcatcatttgatctaagtccaggactgcaaaggattttagataaagtatccagtcctctagaaaatgaaaagctaaaatcaatgactataaacttttccagtttgaatagaaaaaatacagagttaaatgaagaacaagaagttatttcaaacttggagacaaaacaagtgcagggaatttcattttcttctaataatgaagtaaaaagcaagattgagatgctagaaaacaatgccaatcatgatgaaacctcatccctcttacctcgtaaagaaagtaatatagttgatgataatggtctcattcctcctacacccattccaacatctgcttctaagctgacatttccagggattcttgaaacacctgtaaacccttggaaaactaataatgttttacaacctggtgaaagttatttatttggctcaccttcagatattaaaaaccacgatttaagtccagggagtagaaatgggttcaaagacaacagccctattagtgacacaagcttttcacttcagttatcacaggatggattacagttaactccagcctcaagcagttcagaaagtttgtccataattgatgtagcaagtgaccaaaatcttttccaaacattcattaaggagtggcggtgcaaaaagcgattttccatctcactggcttgtgaaaagattagaagtttgacatcttctaaaactgctactattggcagtaggtttaagcaagctagctcacctcaggaaattcctattagagatgatggatttcccattaaaggttgtgatgacaccttggtggttggactggcagtatgctggggtggaagggatgcctattatttttcactgcagaaggaacaaaagcattctgaaattagtgccagtttggttccaccttctttagatccaagcctgactttgaaagacaggatgtggtaccttcaatcttgcttgcgaaaggaatctgataaagaatgttctgttgtcatctatgacttcatccagagctataaaattcttcttctttcttgtggcatctccttggagcaaagttatgaagatcctaaggtggcatgctggttactagatccagattctcaggagccgactcttcatagcatagttaccagttttcttcctcatgagcttccactcctagaagggatggagaccagccaagggattcaaagcctggggctaaatgctggcagtgagcattctgggcgatacagagcatctgtggagtccattctcatcttcaactctatgaatcagctcaactctttgttgcagaaggaaaaccttcaagatgttttccgtaaggtggaaatgccctctcagtactgcttggccttgctagaactaaatggaattggctttagtactgcagaatgtgaaagtcagaaacatataatgcaagccaagctggatgcaattgagacccaggcctatcaactagctggccacagtttttctttcaccagttcagatgacatcgctgaggttttatttttggaattgaagttgcccccaaatagagagatgaaaaaccaaggcagcaagaaaactctgggttctaccagaagagggattgacaatggacgcaagctaaggctgggaagacagttcagcactagtaaggacgttttaaataaattaaaggcattacatcctttaccaggcttgatattagaatggagaagaatcactaatgctattaccaaagtggtctttccccttcagcgggaaaagtgtcttaatccttttcttggaatggaaagaatctatcctgtatcacagtcgcacactgctacaggacgaataacctttacagaaccaaatattcagaatgtgccaagagattttgaaatcaaaatgccaacactagtaggagaaagcccaccttctcaagctgtaggcaaaggcctacttcccatgggcagaggaaaatataagaagggtttcagcgtgaatcctagatgccaggcacagatggaggagagagctgcagacagaggaatgccattttcaattagcatgcgacatgcctttgtgcctttcccaggtggttcaatactggctgctgactactctcagcttgaactgaggatcttggctcatttatcccatgatcgtcgtctcattcaagtgttaaacactggagctgatgttttcaggagcattgcagcagagtggaagatgattgagccagagtctgttggggatgatctgaggcagcaggcaaaacagatttgctatgggatcatttatggaatgggagctaaatctttgggagagcagatgggcattaaagaaaatgatgctgcatgctatattgactccttcaaatccagatacacagggattaatcaattcatgacagagacagtgaagaattgtaaaagagacggatttgttcagaccattttgggaaggcgtagatatttgccaggaatcaaagacaacaacccttatcgtaaagctcacgctgagcgtcaagctatcaacacaatagtccaaggatcagcagctgatattgtcaaaatagccacagttaacattcagaagcaattagagaccttccactcaaccttcaaatcccatggtcatcgagagggtatgctccaaagtgaccaaacaggattgtcacgaaagagaaaactgcaagggatgttctgcccaatcagaggaggcttcttcatccttcaactccatgatgaactcctatatgaagtggcagaagaagatgttgttcaggtagctcagattgtcaagaatgaaatggaaagtgctgtaaaactgtctgtgaaattgaaagtgaaagtgaaaataggcgccagctggggagagctaaaggactttgatgtgtaactgtgctgttgatgaagtcctcccagggaagcctgtgcagatgcagtcacctggaaagaacagagattaccctttcacctacctcagcaaaacaaactttcaagtcttgatagacttagcctagtaattttatagtgagagtttcaaactatatatcagtgtctatagcatcaaaaacttctgggggcgtgggggaagtagaataccaagtataatagttacattcactttcaaagagcatctatgaatttgccttttgtaacttactgtggctttaaacatattcagaacagatgcttgaaatatgcacttagcactttggttccacatctgtctgggtaaaccatgaagaaaatgaagctgctgcctcaatcgacccagacagcagccataggcagataaagatttggtttcaccctggtggtggtaggcatcgtgtgtgactttttttcctctaatatcaattttacagtacggaaatagtattttaaaatagtattggctaataaattatgaattctataaagtagtaagacttggtatggttggagtgtaggaatgaatattcatgaaatgtttcttattgcttttccttccctaattcatacaatgaatgtatttggaatacttacatattataaaataaactatacctcttcaagaggtatcctgttctgtaagatcagatgtttttattgcaggtcaatataatactgccagagacagaaaatacccccttatcagtcccttagtgcctctttctgtttgtggcatggtgagaaaacccatgctgaaaagattgtactttgtgatcccaatcagagggatggagctaatctttttgctgttgaaataaaatgaatttatgagaaacttt

SEQ ID NO: 23015 - DNA, 714 bp, Homo sapiens
ccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactgg

SEQ ID NO: 23016 - DNA, 918 bp, Homo sapiens
ctctctcggtttgtctgggtcatcttgtctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 23017 - DNA, 899 bp, Homo sapiens
ctgcccgccgctggcctggccccgtctgtctctctcagcagctgtctttctcgcgcccactggccggtctctcctcttccccgcagttgcctccttctctgcctgcctgggtggccgccatgggccggaagcggctcatcactgattcctacccggttgtgaagaggagggaggggcccgctgggcacagcaagggggagctggcacccgagctaggtctctgaggggaggagccccagccccgcgacgaggaggaagcggagctggagctgctgaggcagtttgacctggcctggcagtacgggccctgcaccgggatcacacggctgcagcgctggtgtcgggccaagcagatgggcttggagcctcccccagaggtgtggcaggtgctgaagacccaccccggagacccccgcttccagtgcagtctctggcatctctatcccctatgaggcaccacgtaagacctcctgcccttagctctcttgctcaccacccaagaacctcaggacagaagcgagagcccattgctcctgctcagctcagcccggctgcggaggaacccttggcaggcagaacctggaggtgtcagaggctcaactcctccatctaaccagcaggctcccagagtccccggaagagcctgcgcagctgaagcagagtgcttctagatggagagtggtcactggggaaaaggacctggccatcaccttccaatacctgctgcctgtctccctgacccatgatctggcaagttaggcacagtcagacatggacagttgatccatgaggaaaagatgctctcccacctaaggccaggaatctgagagcaggactggctgagctcccagggcaaggggttcactaatgcttatcaataaagaatattgagcctggaa

SEQ ID NO: 23018 - DNA, 3441 bp, Homo sapiens
gcgagagttggtccgcggacgccggaagtagttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 23019 - DNA, 783 bp, Homo sapiens
atggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaa

SEQ ID NO: 23020 - DNA, 3323 bp, Homo sapiens
ttcgtcgctccctagcggccgaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacgggcagccgatgaagtgcaaccttcacatgaatgggaatgttatcacctcagaccagcccatcctgctgcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgtgggggctgtctgaaggaccctgctttttccaggggccgaggggctgcctttcctttgtgtgtattaagcttttcaaacaatggaggggatggagagccctggtgtcctgacgggagccaggtcggcctgagagctgtgccgctcctctgtcttgtcagtggaggtgcctgggtggggagcaggtctcaggcctcttgtcctctccccagtggctccaggcctcactagtggcaagggcaggatgaggctgcaccgctgggaagagtctatctaagctcttggcttggagtcccgtgtcgtctccacccagaggaagttctccagagttcacctttcccttttccttgagttgtgctgaatgccccaccccagctctctttcccttctgggtgtctttgctgggagggggctgtgttgtgagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattccta

SEQ ID NO: 23021 - DNA, 2006 bp, Homo sapiens
gaaggggcgggctcgcggggtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccctcccggttctcacctcgcctggcacttaaccacaccctggttttgtgtagccgccagctctcttctggttgggcctttgaaaggctcagcctcccattgtgcagtgcttgggtttggagcttatttgaatggaagaggtcagtttgttcctggctctccatttctggcctcagttgtctacaggacagtggtcagggatgcctggaggcatatatccagctgccaccaaggggcactgtttgttcccacttatgtgagtgaccccatccatccatgaccagaggattattttcctgccttggcagaggaggaggagtcaagggagcagggcagctctaccaggcaaggtgtttccccagcataggcgcagacagttgggacgaaacttcagagcccaggcagtccctgaatgaccaggccagtgttgtcactgagtggtcccctgctggttgggagtgaagagaatccaggctggcagagctggagccagttggggagcacggttctgggagctctgcaaaatcagtagcaagtgctggaaaaggcacatgccgaagatactcaagagctcccaagatttgcttgaggctagcccagtgaaaaaaaccagagactcatgtttccaggggtcagtctgtcaggcaggaaggacccaggatttgaacccagcttcagtgtgcaggctctgaggctgcccaggacgggaaagtccaaggaaggggcctggtggtgctccacttgcagttctttaaagaatgctgctttttattctcctaaccctttcaagtgggtgcagacttctcgttagcagctggaagacattcctcccacacttttcccttcctggcccaagagagcatccagaaggcagtaggacctggtttttcaggtactgggagccgggggctcactgcttgcactgtgcttagggtagggatggtaaatatcctccctgcatggctttatcctccctctcatcccaaagcaggtatcttctggttgtcacagagtttcattgagtccagctgcagccacgtggccatctggagctggtgctataggtgaccatctggtacattgaggggacctgtttgcctcctccactctataagcagtcatcttgggagaccgggaggagaaggtggtgggctagtcctgtgtcctcctccacttcccatgcctctatgttacccatctgtgtctcctgtgcagaaggagaggaaggggcattaagagatgaagggtgattatgtattacttatccatttctgaataaacatttgttattcct

SEQ ID NO: 23022 - DNA, 1351 bp, Homo sapiens
ttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccagagaatgcatgtggaccctgtggggtggattctgaccactgagtgtttccaggttccacagcagaaagccatggcaccacttcatccccatcctgccggaatgagaatcaatgttgtcaataaccaccaggccaaacagaatttatatgacctggatgaagatgatgatggtatagcttccgttcctactaaacagatgaagtttgcagcctcaggcggctttctccaccacatggctgggctaagcagttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacggcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaatggtacactgaattctctgggtggctttcttgtggccccatgggatgcagcgt

SEQ ID NO: 23023 - DNA, 1340 bp, Homo sapiens
gtctcgactgctttcggcttgctcggcggagcaagatggcggacatctccctggacgaactcatcaggaagcgcggggcggcggcgaaaggacggcttaatgccagaccgggagttggaggtgtccgatctcgagttgggatccagcaaggccttctcagccagtcaacacgcacagccaccttccagcagagatttgatgcccggcagaagattggcctctcagatgcccggctcaaactgggagtcaaggatgcccgggagaagcttttgcagaaagatgcccgatttcgaatcaaagggaaagtgcaggatgccagagagatgttgaactctcgcaagcagcagaccacggtgccccagaagccccgccaggttgctgatgcccgggagaagatcagcttgaagaggagttcccctgctgccttcataaacccacccattgggacagtgacccctgctctgaagctcaccaaaaccatccaggttccaagctttccatgtccaaggccctccctctcaccaaagtggttcagaatgatgcatacacagctcctgctctcccttcctctattcgaacaaaagccttgaccaacatgtcccggacactggtgaacaaggaagaaccccccaaagagctgccagctgctgagcctgttctcagcccattggaaggcaccaagatgactgtgaataatctgcaccctcgagtcactgaggaggacattgttgagcttttctgtgtgtgtggggccctcaagcgagctcgactggtccatcctggggtagcggaggtggtgtttgtgaaaaaggacgatgccatcaccgcatataagaagtacaacaaccggtgtctggacggcggctgagtgacagcccatcaatgaaaaaggagagcgagctgcctcgcagggtgaactctgcctcctcctccaacccccctgccgaagtggaccctgacaccatcctgaaggcactcttcaagtcctcaggggcctctgtgaccacgcagcccacagaattcaaaatcaagctttgagcaggggagtgaggcagccagaagtgggggcagaggagggtggctctgtttccccaaggcaaagcttatgaccaatgggccatcggactggagacccctgattgtgggaagggttgccagggataaagagcttcctcactggatgggacccgcctttctgtgttgtgttctgccctgtgctcttctctctacgttaacgtttcctgtagtatgtttcttcatctcatcgccaaggtaggcttgtgtttttcagtgtgtgcctccccgagcctcagccccaagctgatttcttatctggaaat

SEQ ID NO: 23024 - DNA, 1248 bp, Homo sapiens
cgggtggctaggcgcgtgggaagagccggagcccgacccccgcccacccggtttcctggcagcgcactgccgcgtaggggcggagccgcgcgcctacacagggtgtggcctccagcccgcgcgggaaagggcctgcgccgcatgcgcgcgcacagtcggcggccgcgcgcagcacgctcaaggccgggatggcggcggcggcggcggcaggaagcgggacgccccgagaggaggagggacctgctggggaggcagcggcctcgcagccccaggccccaacgagtgtgcctggggctcgtctctcgaggttgcctctggcgcgagtgaaggccttggtgaaggcagatcccgacgtgacgctagcgggacaggaagccatcttcattctggcacgagccgcggaactgtttgtggagaccattgcaaaagatgcctactgttgcgctcagcagggaaaaaggaaaacccttcagaggagagacttggataatgcaatagaagctgtggatgaatttgcttttctggaaggtactttagattgattgccgagcggggcagttttgtgagccttcatctgaagccttcagttcacccctctgcacaggcctcagctttgaagaacggagtctttgcacttacacacactcttcctgttctgccttcacctatgccgggataagcagagatctcatcaattagctcttctctgcaaggtcttccactatttctgtctgtcttccatatcaagcctggatgcagctgctgctgcttagagcagagatgaagaaagtgttctgcataagtggcttcctgaatgatgaggaccagaataaaggtttttgatcaacctcagtccagtgtgttttataatctcgcctttgttcctaccctgtgactggagagtcaccatacctggtcacagaccttcctgatcttccctgccagccattctaacatacagtcctttcattaattttgttcttttatttttccagcacatcaccagaaagtggttccagaatttatggaacaccacttgccctcaggagttcaaataaatatggtcctagattgaaagccagttaaattttttttaagttttatttattgacatatccacatactctatatttcaccaatttaaagtgtacaattcagtggtatttagtatattcacaaatatgtacaccagtcatcacagtcgattttagaacattttatttatttatttattattattatacttta

SEQ ID NO: 23025 - DNA, 1280 bp, Homo sapiens
agtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatctgtaagaaagatttgctggctgcggtggctcacacctgtaatcccagcactttgggaggccaaggcgagtggatcacggggtcaagagagcgagaccatcctggctaacatggtgaaaccccgtctctactaaaaaaaaaaaaaaaaaaaaaaaaaattagtcgggcatgggggcgagcgcctgtagtcccagctactcgagaagctaaggcaagagaatggtgtgaacctgggaggcgaagcttgcagtgagccgagatcacgccactgcactccagcctgggcaacagagcaagactccgtctcaaaaaaaaaaaaaaagaaaagaaagaaagaga

SEQ ID NO: 23026 - DNA, 1150 bp, Homo sapiens
agggctactaggacgcacgcgcgagatagaacctctagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcaccc

SEQ ID NO: 23027 - DNA, 1355 bp, Homo sapiens
aggaggcggtgcgttgccacggagacggagcagggctactaggacgcacgcgcgagatagaacctctagtctcgtggagagattgaagatggcggcttctcaggcggtggaggaaatgcggagccgcgtggttctgggggagtttggggttcgcaatgtccatactactgactttcccggtaactattccggttatgatgatgcctgggaccaggaccgcttcgagaagaatttccgtgtggatgtagtacacatggatgaaaactcactggagtttgacatggtgggaattgacgcagccattgccaatgcttttcgacgaattctgctagctgaggtgccaactatggctgtggagaaggtcctggtgtacaataatacatccattgttcaggatgagattcttgctcaccgtctggggctcattcccattcatgctgatccccgtctttttgagtatcggaaccaaggagatgaagaaggcacagagatagatactctacagtttcgtctccaggtcagatgcactcggaacccccatgctgctaaagattcctctgaccccaacgaactgtacgtgaaccacaaagtgtataccaggcatatgacatggatccccctggggaaccaggctgatctctttccagagggcactatccgaccagtgcatgatgatatcctcatcgctcagctgcggcctggccaagaaattgacctgctcatgcactgtgtcaagggcattggcaaagatcatgccaagttttcaccagtggcaacagccagttacaggctcctgccagacatcaccctgcttgagcccgtggaaggggaggcagctgaggagttgagcaggtgcttctcacctggtgttattgaggtgcaggaagtccaaggtaaaaaggtggccagagttgccaacccccggctggataccttcagcagagaaatcttccggaatgagaagctaaagaaggttgtgaggcttgcccgggttcgagatcattatatcttctctgttgagtcaacgggggtgttgccaccagatgtgctggtgagtgaagccatcaaagtactgatggggaagtgccggcgcttcttggatgaactagatgcggttcagatggactgagcttggatgcttctgaggcaagctgaagctttgggttctgactgacccaccctacaggactgctgaacagagagcccagtgtgactagggatcctgagttttctgggacaattccagctttaatcaatacattttgttaaatgtgccataaaatgagactttttacgcctttataaggccttagatgtaaataaactcacccaaacaaaaaaactttttgagacta

SEQ ID NO: 23028 - DNA, 1945 bp, Homo sapiens
gtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagaggaaagcaatagaagaactgcttaaggaggcaaaacgtgggaaaactagagctgaaacaatgggacccatgggttggatgaagtgtcctcttgctagcaccaataaaagatttctaattaacacaattaaaaacacattgccctctcataaagagcaagaccatgaacaaaaagagggcgataaggaaccagcgaagagccaggcccagaaagaagaaaacccgaagaaacacagaagccatccttacaagcacagcttccgcgctcgaggttccgccagttactccccgccacgaaagcggagcagccaggacaagtacgaaaagcggtccaaccggcggtgaggctggaaccagggccagccagccctgcgggcctccgtgctccttcggggtgcggtgtgcggagaaggcctgagctggcagggcaaacacctgagagtgactttgacattaggtcctttgttgtttttaaagaggctgctggccacaggcaaaaaaaatgacctagcaactcttgaggaaacaagtgcaaaggaggatgtcttggcaagtttaagctacttctgcagtgtagtagacttacatattgttgtttatcttgtttggaagtgtgtttcaaaataaacatgtctagaatttaaagttttcagagattgttaaaactggttccaattttttggtcatttctcagaaaaataaaatacttataaatcctatattttactttttgggggtattacatttaaaatttagaaatcatcagtccagtgaccatatttatgaaaagctgtagccctccaaggtctgggaatttatcgagaagctctttgatagctctgcatttgttttcccttaggtgaacaatgtaggaaatcctcaaagtggctttgaatttaatgctccacttcagttaccagaggttaaaaatgggttttgttgtttcctgtgcattctcaaactcatttattagatagaacaatctttctatatttaatttttttaatatataggtcttaagtggtgctttaaaaagaaccctcacaagttaaaaattaagagttgtttcagtgctagatcttaccagctaaagacttgtgataccactatatagtatagttgttccagaaatcttcattttaaatagaagtgtttacaatgccttttttcccccagtattggttttcaatacctgttttcatatacaattacaaacctttcaaacctgtattccttctttatactcaggaaaatgtcaccaagcaccctcctccccagttcacaaaaggaagaagatgaagattctgtctccctgttccccctccccagttttccaaagtgtctgagcatatgcctggctgtcctcagatcatcaccatgccacatccctgctccctacttcctggcagccaagaaaagccctttctacatgctagaaggaaatacatccaaaaagttagcattggagtgttagaaactagaatagacctctccgccaccgagctgctgtgtcacgccctcagcctgctagggagtgacaagcccaagtcattcttgatccaccccttctcccaccccagatcccagggactcatcctgtgactttgtaaccacactcattcctttcaaacacagaggaggaattattgcttcatctgactttattcaaatctagttatgtattggcctaaattatttgtgcaaaatttgaaatgttttttatttaaatattagaaatagcacaaagtcatggagtttttaaaaattgttataattaagtaaaaataaagctgaattgtgtca

SEQ ID NO: 23029 - DNA, 1626 bp, Homo sapiens
ccccactcgccccgggctgtccccgccgcccgcctgattcccctgcggaagccccgctggctaggtgtctgcgcgcacccccggccgccgccaagagtggcacagctggggaaggagtgaacatccagaggaatcgcggggcggggtggggggaggccaggagaacaggtggcgcagggaagcagaaacgtagttgcgctggacagctggagtcgggcagggtcggggccagcggcgaggggacaagaagggccgattcgagaggaagcgcacctgagggagcacagcgaaggccgggacgcagggagctggatggagagcgagcctgggcggcgaaaggttgccgaggcgggggctgggcgcctgggaacaaagttgaaaatgcaactgcaagctccccggtgaaacaaataccgccttcaaccttcgtattctgtggtgactcatctcgcacgtgacccccctccctcttcaaggtgtgttgaccgactacagtttaagcctgtcgtcccacaaaaggcccgggagggccggggtcccaggaagggccatcctgggtcaacaccgccccagttgggaagtcgggccgctttcggacttgccactgggaagggaagtgatttgggggcggcaggtaaggccgcgccccttcgccatcacctggggaaaggtaccagagttgagccggggcgcccgcaggcctgtctgggcctcggggtaaggcggcgctggccccgccccctgcccctcccgccgcgagtggcctcgcgtggtcgcccaggtgagccgcggggccgcgagccaccgctcaccccgcgtcggggcgggggctgggggtggagcctcatgccccgccccgcggctgggccctgccgcgccgctgcggctcctcctccctccttccgtcctccgcgccttccgtcggtcggtccttgcttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttatttaaacta

SEQ ID NO: 23030 - DNA, 690 bp, Homo sapiens
ccttgcttcctgcttcgcctccgcgcctcgcgctatgggacagagcccccgatccgccagcaccacctgaggatccagaaaccgccccagcgatggaagaggatcaggagctggagagaaaaatatctggattgaagacctcaatggctgaaggcgagaggaagacagccctggaaatggtccaggcagctggaacagatagacactgtgtgacatttgtattgcacgaggaagaccataccctaggaaattctctacgttacatgatcatgaagaacccggaagtggaattttgtggttacactacgacccatccttcagagagcaaaattaatttacgcattcagactcgaggtacccttccagctgttgagccatttcagagaggcctgaatgagctcatgaatgtctgccaacatgtgcttgacaagtttgaggccagcataaaggactataaggatcaaaaagcaagcagaaatgaatccacattctagtcctttatgcagtatacaaggagaactgtcctgtaggatattctcttcctgatggtgcagaacccagaattagaagtttgtggttacagcatactctgtccttcagaaaggcgtgattctagctgttgaccccttgcagctgttggaatctctgcaagaacctctgtattcttctaataaattccctcttttattt

SEQ ID NO: 23031 - DNA, 6568 bp, Homo sapiens
gggagctgaaaaatttccggtaagggaaagaagggctcctttcgctccttatttccccgcctccttccctcccccaccttcccctcctccggctttttcctcccaactcggggaggtccttcccggtggccgccctgacgaggtctgagcacctaggcggaggcggcgcaggctttttgtagtgaggtttgcgcctgcgcagcgcgcctgcctccgccatgcacgggggtggccccccctcgggggacagcgcatgcccgctgcgcaccatcaagagagtccagttcggagtcctgagtccggatgaactgaagcgaatgtctgtgacggagggtggcatcaaatacccagagacgactgagggaggccgccccaagcttggggggctgatggacccgaggcagggggtgattgagcggactggccgctgccaaacatgtgcaggaaacatgacagagtgtcctggccactttggccacattgaactggccaagcctgtgtttcacgtgggcttcctggtgaagacaatgaaagttttgcgctgtgtctgcttcttctgctccaaactgcttgtggactctaacaacccaaagatcaaggatatcctggctaagtccaagggacagcccaagaagcggctcacacatgtctacgacctttgcaagggcaaaaacatatgcgagggtggggaggagatggacaacaagttcggtgtggaacaacctgagggtgacgaggatctgaccaaagaaaagggccatggtggctgtgggcggtaccagcccaggatccggcgttctggcctagagttgtatgcggaatggaagcacgttaatgaggactctcaggagaagaagatcctgctgagtccagagcgagtgcatgagatcttcaaacgcatctcagatgaggagtgttttgtgctgggcatggagccccgctatgcacggccagagtggatgattgtcacagtgctgcctgtgcccccgctctccgtgcggcctgctgttgtgatgcagggctctgcccgtaaccaggatgacctgactcacaaactggctgacatcgtgaagatcaacaatcagctgcggcgcaatgagcagaacggcgcagcggcccatgtcattgcagaggatgtgaagctcctccagttccatgtggccaccatggtggacaatgagctgcctggcttgccccgtgccatgcagaagtctgggcgtcccctcaagtccctgaagcagcggttgaagggcaaggaaggccgggtgcgagggaacctgatgggcaaaagagtggacttctcggcccgtactgtcatcacccccgaccccaacctctccattgaccaggttggcgtgccccgctccattgctgccaacatgacctttgcggagattgtcacccccttcaacattgacagacttcaagaactagtgcgcagggggaacagccagtacccaggcgccaagtacatcatccgagacaatggtgatcgcattgacttgcgtttccaccccaagcccagtgaccttcacctgcagaccggctataaggtggaacggcacatgtgtgatggggacattgttatcttcaaccggcagccaactctgcacaaaatgtccatgatggggcatcgggtccgcattctcccatggtctacctttcgcttgaatcttagtgtgacaactccgtacaatgcagactttgacggggatgagatgaacttgcacctgccacagtctctggagacgcgagcagagatccaggagctggccatggttcctcgcatgattgtcaccccccagagcaatcggcctgtcatgggtattgtgcaggacacactcacagcagtgcgcaaattcaccaagagagacgtcttcctggagcggggtgaagtgatgaacctcctgatgttcctgtcgacgtgggatgggaaggtcccacagccggccatcctaaagccccggcccctgtggacaggcaagcaaatcttctccctcatcatacctggtcacatcaattgtatccgtacccacagtacccatcccgatgatgaagacagtggcccttacaagcacatctctcctggggacaccaaggtggtggtggagaatggggagctgatcatgggcatcctgtgtaagaagtctctgggcacgtcagctggctccctggtccacatctcctacctagagatgggtcatgacatcactcgcctcttctactccaacattcagactgtcattaacaactggctcctcatcgagggtcatactattggcattggggactccattgctgattctaagacttaccaggacattcagaacactattaagaaggccaagcaggacgtaatagaggtcatcgagaaggcacacaacaatgagctggagcccaccccagggaacactctgcggcagacgtttgagaatcaggtgaaccgcattcttaacgatgcccgagacaagactggctcctctgctcagaaatccctgtctgaatacaataacttcaagtctatggtcgtgtccggagctaaaggttccaagattaacatctcccaggtcattgctgtcgttggacagcagaacgtcgagggcaagcggattccatttggcttcaagcaccggactctgcctcacttcatcaaggatgactacgggcctgagagccgtggctttgtggagaactcctacctagccggcctcacacccactgagttctttttccacgccatggggggtcgtgaggggctcattgacacggctgtcaagactgctgagactggatacatccagcggcggctgatcaagtccatggagtcagtgatggtgaagtacgacgcgactgtgcggaactccatcaaccaggtggtgcagctgcgctacggcgaagacggcctggcaggcgagagcgttgagttccagaacctggctacgcttaagccttccaacaaggcttttgagaagaagttccgctttgattataccaatgagagggccctgcggcgcactctgcaggaggacctggtgaaggacgtgctgagcaacgcacacatccagaacgagttggagcgggaatttgagcggatgcgggaggatcgggaggtgctcagggtcatcttcccaactggagacagcaaggtcgtcctcccctgtaacctgctgcggatgatctggaatgctcagaaaatcttccacatcaacccacgccttccctccgacctgcaccccatcaaagtggtggagggagtcaaggaattgagcaagaagctggtgattgtgaatggggatgacccactaagtcgacaggcccaggaaaatgccacgctgctcttcaacatccacctgcggtccacgttgtgttcccgccgcatggcagaggagtttcggctcagtggggaggccttcgactggctgcttggggagattgagtccaagttcaaccaagccattgcgcatcccggggaaatggtgggggctctggctgcgcagtcccttggagaacctgccacccagatgaccttgaataccttccactatgctggtgtgtctgccaagaatgtgacgctgggtgtgccccgacttaaggagctcatcaacatttccaagaagccaaagactccttcgcttactgtcttcctgttgggccagtccgctcgagatgctgagagagccaaggatattctgtgccgtctggagcatacaacgttgaggaaggtgactgccaacacagccatctactatgaccccaacccccagagcacggtggtggcagaggatcaggaatgggtgaatgtctactatgaaatgcctgactttgatgtggcccgaatctccccctggctgttgcgggtggagctggatcggaagcacatgactgaccggaagctcaccatggagcagattgctgaaaagatcaatgctggttttggtgacgacttgaactgcatctttaatgatgacaatgcagagaagctggtgctccgtattcgcatcatgaacagcgatgagaacaagatgcaagaggaggaagaggtggtggacaagatggatgatgatgtcttcctgcgctgcatcgagtccaacatgctgacagatatgaccctgcagggcatcgagcagatcagcaaggtgtacatgcacttgccacagacagacaacaagaagaagatcatcatcacggaggatggggaattcaaggccctgcaggagtggatcctggagacggacggcgtgagcttgatgcgggtgctgagtgagaaggacgtggaccccgtacgcaccacgtccaatgacattgtggagatcttcacggtgctgggcattgaagccgtgcggaaggccctggagcgggagctgtaccacgtcatctcctttgatggctcctatgtcaattaccgacacttggctctcttgtgtgataccatgacctgtcgtggccacttgatggccatcacccgacacggagtcaaccgccaggacacaggaccactcatgaagtgttcctttgaggaaacggtggacgtgcttatggaagcagccgcacacggtgagagtgaccccatgaagggggtctctgagaatatcatgctgggccagctggctccggccggcactggctgctttgacctcctgcttgatgcagagaagtgcaagtatggcatggagatccccaccaatatccccggcctgggggctgctggacccaccggcatgttctttggttcagcacccagtcccatgggtggaatctctcctgccatgacaccttggaaccagggtgcaacccctgcctatggcgcctggtcccccagtgttgggagtggaatgaccccaggggcagccggcttctctcccagtgctgcgtcagatgccagcggcttcagcccaggttactcccctgcctggtctcccacaccgggctccccggggtccccaggtccctcaagcccctacatcccttcaccaggtggtgccatgtctcccagctactcgccaacgtcacctgcctacgagccccgctctcctgggggctacacaccccagagtccctcttattcccccacttcaccctcctactcccctacctctccatcctattctccaaccagtcccaactatagtcccacatcacccagctattcgccaacgtcacccagctactcaccgacctctcccagctactcacccacctctcccagctactcgcccacctctcccagctactcgcccacctctcccagctactcacccacttcccctagctactcgcccacttcccctagctactcgccaacgtctcccagctactcaccgacatctcccagctactcgccaacttcacccagctattctcccacttctcccagctactcacctacctctccaagctattcacccacctcccccagctactcacccacttccccaagttactcacccaccagcccgaactattctccaaccagtcccaattacaccccaacatcacccagctacagcccgacatcacccagctattcacctactagtcccaactacacacctaccagccctaactacagcccaacctctccaagctactctccaacatcacccagctattccccgacctcaccaagttactccccttccagcccacgatacacaccacagtctccaacctataccccaagctcacccagctacagccccagctcgcccagctacagcccagcctcacccaagtacaccccaaccagtccttcttacagtcccagctccccagagtataccccaacctctcccaagtactcacctaccagtcccaaatattcacccacctctcccaagtactcgcctaccagtcccacctattcacccaccaccccaaaatactccccaacatctcctacttattccccaacctctccagtctacaccccaacctctcccaagtactcacctactagccccacttactcgcccacttcccccaagtactcgcccaccagccccacctactcgcccacctcccccaaaggctcaacctactctcccacttcccctggttactcgcccaccagccccacctacagtctcacaagcccggctatcagcccggatgacagtgacgaggagaactgagggcacgtggggtgcggcagcgggctagggcccagggcagcttgcccgtgctgctgtgcagttcttgcctccctcacggggcgtcacccccagcccagctccgttgtacataaatgccttgtggcagagctcccggtgaacttctggatcccgtttctgatgcagactcttgtcttgttctccacttgtgctgttagaactcactggcccagtggtgttctcactcctaccccacccaccccctgcctgtccccaaattgaagatccttccttgcctgtggcttgatgcggggcgggtaaagggtattttaacttaggggtagttcctgctgtgagtggttacagctgatcctcgggaagaacaaagctaaagctgccttttgtctgttattttatttttttgaagtttaaataaagtttactaattttgaccaaaa

SEQ ID NO: 23032 - DNA, 2057 bp, Homo sapiens
atggacagtacaaacagtactaccacgaacgtccctgcactcgtatctttgtttacaactgcaagtgtttctgcagtatgaattcttagaagtgttactgttaagtgaaggacgtatgcgtgttttgccaaactaccctccgagatagctgaatctggtacattttaaagcaggaggccgcagaagacgctcggcagttctggcctccgagcagcaggcggcgctgtgagtcgtctttgcggaagccgcggaggcctcgctgactgacttccggtgttggcggtggcgccgcgcagtcaccgcggagcagacgcggaggctggtggcccctgggcgagatgccgtacgccaaccagcctaccgtgcggatcacggagctcactgacgagaatgtcaagttcatcatcgagaacaccgacctggcggtggccaattcgattcggagggtcttcatcgctgaggttcccataatagccattgactgggttcagattgatgccaattcctcagttcttcatgatgaattcattgctcacaggcttggattaattcccctcattagtgatgacattgtggacaagctgcagtactctcgggactgcacatgtgaggagttctgccccgagtgctcggtggagttcaccctcgatgtgcggtgcaatgaagaccagacgcgacatgtcacgtctcgagacctcatctccaacagcccccgggtcattccggtgacatcccggaaccgagataatgaccccaatgactacgtggagcaggatgacatcctcatcgtcaagttgagaaagggccaggagctgagacttcgagcctatgccaaaaagggctttggcaaggagcatgccaagtggaaccctactgcaggggtggcttttgaatacgatccagacaatgccctgaggcacacagtgtaccccaagcccgaggaatggccaaagagtgagtactcggagctggatgaggatgagtcgcaggctccctatgaccccaacggcaagccagaaaggttttactacaatgtggagtcctgtggctctctgcgtcctgaaaccattgtcctgtcagccctctcaggattgaagaagaaactgagtgatttacaaactcaattaagccacgagatccagagtgatgtgctaaccataaattaactgcagcttgcctgcttcagcaaaaacggagattcaggccagcagctggatatgggggtctctcttcagactcttctcgtttctgagaatctagtctactgttggttgagcttcttggcaggacatcagtaccaactagaagtgggtcatagatagattaccagggatgcagtggtgtttaggcaggataggtctttactggccctgactgctgttaataattggcagcagtgctccccagatcccagaaggtccctgctggagtgtttccagtgcacctgtagggaaccaactagacttctctcctggttagtccagctctttactctaaaccctttctgtccaaaatgagtcattttcagttgtaccttagatgtctggtgttgaggatcaagtgccatagcctttattcagggggcctataaacccttccagttcttgccccagggctggcctgctagcgcttcaaattcccaggtgtccctaatttgagaagtaaccttttggaatagcattagaccctggctgtcccctccccaccaaataaacatgatatttcattctctgtccagcagtcatgaaccccttcacctccaatgacctgatcatttagtttggtgggggtgggggtgggggtgggggtggaagcagccgcaggagcaagggcccctcccacatacacaggaggagtatttcatttctccttaatgaaggctctggccctaacccctcagcactgtctccagataggaacatgcacaaagcagttaattaggcagcctggagaaaaccagagatccagtacagaaaggaaaggatatttattgattaacagaagttgtctttttaaaagtgtttatttttggcaataaagagcacaacataatctcc

SEQ ID NO: 23033 - DNA, 2866 bp, Homo sapiens
ggattcggcgcaggcgcagtccgcgcgggttctcgcgcggagaaggggtgcgagcggcggcggcggcggaggctgccatggacgacgaggaggagacgtaccggctctggaaaatccgcaagaccatcatgcagctgtgccacgaccgtggctatctggtgacccaggacgagcttgaccagaccctggaggagttcaaagcccaatctggggacaagccgagtgaggggcggccgcggcgcacggacctcaccgtgctggtggcccacaacgatgaccccaccgaccagatgtttgtgttctttccagaggagcccaaggtgggcatcaagaccatcaaggtgtactgccagcgcatgcaggaggagaacatcacacgggctctcatcgtggtgcagcagggcatgacaccctccgccaagcagtccctggtcgacatggcccccaagtacatcctggagcagtttctgcagcaggagctgctcatcaacatcacggagcacgagctagtccctgagcacgtcgtcatgaccaaggaggaggtgacagagctgctggcccgatataagctccgagagaaccagctgcccaggatccaggcgggggaccctgtggcgcgctactttgggataaagcgtgggcaggtggtgaagatcatccggcccagtgagacggctggcaggtacatcacctaccggctggtgcagtagctaccgcctgacagcccctagaggcggacacacagcgacccccatccctgcaggacaaacgcccctgccctgccagaatccggcccccacagctctcacggctgctgctcctctggactccccaaggcaggtggcctccacccacgttctcccgtcctggggtgaggcttcctgtggcccagcccgccccattcacctgtggatttgtgcgagatgcagcctcagaaggaacaaggcccccagagggaggtcacctgggggcagctggtgccgggtcttcacccagaccacgctgggtcccctctgttgggggtttggggtccgggtctcccaccagccactgcttcctcctgggccctcggccttccacccctcgtcttccctccctcgggggccctgatgcgtggcggcccccgcccggcctcggctctttactccattcacagccatgcacgcgctcaagccaccagggtgcgagatgccagctctggagttctcggttgttgtaggaggttgggtgttttcaaatggtaaagatgttttgagcaaataaatttgcttgatacagaaaccaggccgactaacaaggtttccagcaggtggccttgcctcaccccaagcacacgaggtcagcctggcaggtgtgccctcctcgcgctggcttcaggggtcagtgtctccccaggccctcgccctgccctcccacttcgtgctcctgggtaaggcgtgagcgtgtctgtctcttcccttcccgtgagggtgtggagttgttctctggcttgtgcagctgtggtttgcggccagttcctcttacagacgtttgggatctggctctacttccccgtttgcttactgtctgatttcagaaggcctcgcctgcccaagtttaacctagccacgtggttctctcacagtagctttattaagatgtaattcaccctcgggcggtcggtggtctgtaacgcgcccactgttctgtgcagcagggtccccagatccccaggccgcggactgtgtgtgtgatggggacagtgcttccccttctctccaaatgtacttttttcaaaattgtcttggccaaagcaagccagacccaaagggacaaacactgatgtcactcctaggaggtcactagagtcgtcagagactggaagtaggatgggggttcccgggactggggagttgggtggggatgggggttcccagggctggggaggagggaggggacagagtgtgtcatgtgcacagttttagtttgggaagatgagaaaattctggaggtggccgggcgcggtggctcacgcctgtaatcccagcactttgggaggccgaggtgggcggatcacctgaggtcgggagttcgagaccagcctgaccaacatggcaaaatcccatcactgcaaaaaatacaaaaattacctgggcgtggtggtgcatgcctgtaatcccagctacttgggagctaaggcaggagaatcacttgaacccaggaagtggaggatcgcttgagctcaggagttaaaagaccagcccgggcaacacagagaaaccccccacctctacaaaaaactttaagattacctgggcacagtggctcacacctgtaatcccaacactttgggaggctgaggcgggaggatcatttgagcccaggaggccgaggctgcagtgagctacgattgtgctcctgtactccagcctgggccacagggtcacaccctgtctcaaaaaaaaaaaaaaatgcagttccacaggcgcatgggccacgtttccagtgcttggtggccatgtggggctgacgtgcgaaaccttagagccgggggatacgtccgtcatcgagaacgttttcctggactgccctgggctgcaggtggacgtgacgaggtcattcgatgcctgaccgtctgcacagcctgtggtgaagaccacccgggctcccacctcgcggggccccgtggcggggggttcccttcctcacacatccctcccctagggggaggcccagggccacgccacggggctctctctgtcccctccctggccccttcttctaagcttgcagctgccacagaaaatcttctaagcttgcagctgccacagaaaacacccgattaaaaactttttatttcagcaaaataaacgtgcctgtgaaagaa

SEQ ID NO: 23034 - DNA, 560 bp, Homo sapiens
gcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaacttctctgggggctggaatacacagtgctgagaccctcctacgcactggcccacagcctaggctctttcagcatctcctcccgctgacttctcccgacagtcctgctgggtggatatcatcaccccattgtacagatgcataaactgagcccaggttgctgatggtctcacccgagctgaacacaggat

SEQ ID NO: 23035 - DNA, 582 bp, Homo sapiens
ataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaacgcccgctcggcctcagaaccgcccggagaggagccgccctggatggacagagggacgagggacgagcatctgccgtcgtgtcccggctgccctgcagtcgcctccaacacccgctgctgcccgcccgctgcctgcctgcctggcatctctctctcccggaggcggcggctcagagaggagtgactcgcctgaagccc

SEQ ID NO: 23036 - DNA, 2106 bp, Homo sapiens
agtgatttcctctgggttacggcgcaggcgcaagataagctaggagccgcgcgagtcgtagtgtcgctgtttgcgggtctccgcgcgggaccggggcgcagcggggtcgctgaggcgagggtgtcatgtcagacaacgaggacaattttgatggcgacgactttgatgatgtggaggaggatgaagggctagatgacttggagaatgccgaagaggaaggccaggagaatgtcgagatcctcccctctggggagcgaccgcaggccaaccagaagcgaatcaccacaccatacatgaccaagtacgagcgagcccgcgtgctgggcacccgagcgctccagattgcgatgtgtgcccctgtgatggtggagctggagggggagacagatcctctgctcattgccatgaaggaactcaaggcccgaaagatccccatcatcattcgccgttacctgccagatgggagctatgaagactggggggtggacgagctcatcatcaccgactgagctggagtcatcttcctgcccttgccccatgcccaattttcattctcactttatatgtgtaaataataaaatattcaactttccaacccccttcccctctgcttatctgcaatgtcaccacctgttgcttccccgttaccgccatgctgcgtggagcatgcacctattccagtggccctgtgactgtcagctccttaagaagcaccaggggcccttagcccctttggatcccccacatccttccctccatctccctgttccccagagcaaaggctgctgcaggggagacacctcagctgccttccaagcagacagacaagtctttgtgcccagggagctggttgccacggaaacccccaatttcctttccagtggggactggctgcaggggcttctcccttctcaggagtatcacagagcaggtctcatcaagccacccattgtttcctaaggacctgcttcgagcctcttatcgtgggctcggatcccctttcaggagcagtgccccagcaggaagcgtgggggtgtgctgatctcccaccctccccaggcagagccctgctgggcaagtcagcagctggagcaaggaccgagcacctgcctacccctgcccccatggctctgtccccactcctcctcaggactctgcccacacgctgtcctctgtggcccacctctttggtgtgccacacccatgccttcttcctagcctctataagatatcctttccctcctatttggggctggtgatcccctgaggccttggggacatggtgctggggtggtggtgctcctgggttccaggtgttacattaagtcagagctggagttcccccttcctctgcctgaggttctaatgggtcctcttcctttctccaccctgcttacccaacctgaggtaagaccagtcacactggctcctccctcctagagggggtcagggggagggtgtatattgacatgaacagggatagagggtaaactggctccctgaatatgccagccttaacctccattccactgccagctccccttcaaagaggaggagctgggcttccctaacctctgcaggaggcagggcctccaggcctaggtgcagcctggccctgggatgggatgtggggagtgaatggtgaggatctgcattggtgggaggggtgtccgctgccctggagaagggttaattcagggagcagtggacttcacactcccatccaccctcctccaagcctgtggaatcctttaatcaagttgggtgctgaaatttcagctctgaaatgccgcctttgtgctggcatccaggcagccgccccagagtgcgggggtcactttctcggccccatttctctaaatggtctctttgttccctgctgggctgctcagtatcagatgtgattaaagggagatggggtttgggctggggaggaggggaattgggggttaacccttaggggatagagtgcaagggaaatgggacagaaggggtgtttttcctcctgtcttcctcttcccattctcctcttttggggagtcccctgctattcagctgtctgggcctggcttttgacttctcttgaataaaatgtcccggtcacca

SEQ ID NO: 23037 - DNA, 827 bp, Homo sapiens
agtcgcagcaagcgcggaactggggttgcggcgtctaagtgtttccggtggattcccagggactgtcggaggtgtggactctgcctgcctacctggtctgggaagatgttctaccatatctccctagagcacgaaatcctgctgcacccgcgctacttcggccccaacttgctcaacacggtgaagcagaagctcttcaccgaggtggaggggacctgcacagggaagtatggctttgtaattgctgtcaccaccattgacaatattggtgctggtgtgatccagccaggccgaggctttgtcctttatccagttaagtacaaggccattgttttccggccatttaaaggggaggtcgtggatgctgttgtcactcaggtcaacaaggttggactcttcacagaaattgggcccatgtcttgcttcatctctcgacattccatcccttcagagatggagtttgatcctaactccaacccaccatgttacaagacaatggatgaggatattgtgattcagcaggacgatgagatccgcttaaagattgtggggacccgtgtggacaagaatgacatttttgctattggctccctgatggacgattacttggggcttgtaagctgagcctggtggcctcctacccttggtcctactctaggaagtgtgattgtcacacttatcatgttgtccagaggtccagtctggctgctgttgtggaggcaaggaaggcaactcatcccagaaggcatctggtgcttcttgtagcttaactactgcctcctcatttttcagtatgtgttctaagtataaaaagtccttggttctca

SEQ ID NO: 23038 - DNA, 821 bp, Homo sapiens
tccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgt

SEQ ID NO: 23039 - DNA, 836 bp, Homo sapiens
ggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtgggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgt

SEQ ID NO: 23040 - DNA, 823 bp, Homo sapiens
gaagagctggtatccaagggacagggcagtgccaggctgaaggggcacggaggggatccgtgtccaggagaaggcagtggagggggaacgcgcagcactaagctggagggagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagc

SEQ ID NO: 23041 - DNA, 1802 bp, Homo sapiens
gggacggcccagccaggctggggtccgcgcggggcctcccgagaggcggcaaggggcgctgggaaggcgcaagcccgcgccggctccctgcggatgcccgggtcggagaggggcgcccgggaggggcgggtctactggcacgtggaggggccggcccgggttcgcggttccccgtgcccaggcaggaggggctgcagacgcctgagctccgtaggggttggggctgggggctgcggagctgtctacatcggactcctccgggtcagcccgttaggagccgcctcccctctgcccctccgaagagacgagcggcccagacaggcctgggaaggcccctctgccccgtcaggggtgaaaagcaaagctggaaggattcggagagggttggggccgtcttcctcatccttccttttctcggggctcccgtggcgacgtcatggcaaattcccaaactggacggatccggctcgggttacgtccagcagggccgagccggcccaggccggccccggggtcctcggtgccggctggaggggctgggcacctctggggcggggttctgctccacctgccctcggcgcggactgtgccctcggcgggcacgcggaccggcggggtagggctagggcccggcttctctgggccaaggatcaaggtccctgcctgggttaggcccccacgcattccagtcttcggaacccggcctctgaagagggcgcagtagggccccagcggagcgcgagaacccgctctacagcctattgcttccccgccctgggcagagccacctggacatgagacccgccctcaatgccgaagcctctcggaagcaatctttcgggacggaagttaagtagccccgagcgggaggctgtggcggaagtggtcgcgttaccgcttgtttgtgcgcatgcgccactctcgtctggccgccgcgctttcaggaggtgcttttggttctctccggtcttgtccacgctagggggtgcacgtactcccaactgtggtcgcgctctcaccccttctgctgctctcgtggccccctcgcgatggcgggcatcctgtttgaggatattttcgatgtgaaggatattgacccggagggcaagaagtttgaccgagtgtctcgactgcattgtgagagtgaatctttcaagatggatctaatcttagatgtaaacattcaaatttaccctgtagacttgggtgacaagtttcggttggtcatagctagtaccttgtatgaagatggtaccctggatgatggtgaatacaaccccactgatgataggccttccagggctgaccagtttgagtatgtaatgtatggaaaagtgtacaggattgagggagatgaaacttctactgaagcagcaacacgcctctctgcgtacgtgtcctatgggggcctgctcatgaggctgcagggggatgccaacaacctgcatggattcgaggtggactccagagtttatctcctgatgaagaagctagccttctgaacctcgcctgaagccagcctctctgccaagtcactcaggtcatgggcattgttcaagcctgagtggcagccgctcttgctcacctgttgaggaagggctggctcactgtccaccgtggcggcatctttaactggcctccactcaatgggaaactgactcgcctgtgaaagacacagtgggagagctgaaaatgaatcagaagctttatgtatatgatttttaaattaaactttactttttcagactgcccctcccctttttgtaaaaagtccatttactgtaaaatcgttttttccagtt

SEQ ID NO: 23042 - DNA, 871 bp, Homo sapiens
ggcccgggaaaggaccagaacaggcggcgaagactgaagcccggaggtaggagtggcaagagctcgcccagtccgcgaagggtaaactcgcgcatgcgcactggccttcaaccaagccaagcgccttggcttctgtcctggatgctcagtgttttgcggtttacgatgcgcatcgttttcccggctctggcaccagatccatactattctgtaaactgaggcggcgatgcccaaaaattggaagcaattactctaagatatcaaaagattgaagcaagccatgaaacctctgcgcggagagagccgagcccgaggcggcggggagccagcacgtgtgcgcagctccgccctcttttggcgaagcacctaggcctggcccctcccgcgacctgtagcgcggcggagcaagcgcggaaggctgggagggctgcgcgggctgcgcgtcgccatggagcccgacgggacttacgagccgggcttcgtgggtattcgcttctgccaggaatgtaacaacatgctgtaccccaaggaagacaaggagaaccgcattctgctctacgcgtgccggaactgtgattaccagcaggaggccgacaacagctgcatctatgtcaacaagatcacgcacgaagtggacgaactgacccagattatcgccgacgtgtcccaggaccccacgttgccgcggaccgaggaccacccgtgccaaaagtgcggccacaaggaggctgtgttcttccagtcacacagtgcgcgggccgaggacgccatgcgcctttactacgtgtgcacagccccacactgcggccaccgctggaccgagtgacctcctctctcccccgagtgtaataaacaccagattccatgcgtg

SEQ ID NO: 23043 - DNA, 932 bp, Homo sapiens
gcggcggcggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcgggagagacctggatgtggacttgagcagcggtgacttcgcaagcaaatggattgtcaggcttgatgcaggcagatgacctgtttcaggggcgtccggctggcagggatgaattcattctggaccaaagatccggggtccaggggctgctgcgggggctgtgctgagccggagagaagtgtgcaaacccatgagctcccaagagtctctgctctagaagcctcaactcctgggcctgcctgtcagtcaaagcaggaacacttcttcctgcataactcgaaacacctttccacaggcttcttgtccacagtagagtttaataaaaatattcactgaaagacccccccc

SEQ ID NO: 23044 - DNA, 609 bp, Homo sapiens
ggcggacccttggggtctggacgcaacggcggcgggagcatgaacgcccctccagccttcgagtcgttcttgctcttcgagggcgagaagaagatcaccattaacaaggacaccaaggtacccaatgcctgtttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgctttcgggtgagggcggggcctggaggggcagacggggtggccataaaagacaagcaggaaggaattgagtaggggccagagggggctctgctcggcctgtgagccccgttcctacctgtgcctgaccctccgctccaggtaccacaccgaggagagcggccggtcccagccatggcccgccttgtggccacccctcaccctgacaccgacgtgtcctgtacatagattaggttttatattcctaataaagtatagcgg

SEQ ID NO: 23045 - DNA, 351 bp, Homo sapiens
atgaacgcccctccagccttcgagtcgttcttgctcttcgagggcgagaagatcaccattaacaaggacaccaaggtacccaaggcctgcttattcaccatcaacaaagaagaccacacactgggaaacatcattaaatcacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctga

SEQ ID NO: 23046 - DNA, 1714 bp, Homo sapiens
agcccaacggggggcgatgagccgatccttgggcgggtttgccccgccggagtaatccggaagaggcctcttattagggctctggtggcggcggtggcggacacttggggtctggacgcaacggcggcgggagcatgaacgcccctccagccttcgagtcgttcttgctcttcgagggcgagaagatcaccattaacaaggacaccaaggtacccaaggcctgcttattcaccatcaacaaagaagaccacacactgggaaacatcattaaatcacaactcctaaaagacccgcaagtgctatttgctggctacaaagtcccccaccccttggagcacaagatcatcatccgagtgcagaccacgccggactacagcccccaggaagcctttaccaacgccatcaccgacctcatcagtgagctgtccctgctggaggagcgcttccggacgtgcctgcttccccttcgccttctgccgtgattgtcagtttcctgaggcctccccagccacgcttcctgtacagcctgcagaactctgccccagagcacatcagctatgtgccccagctctcaaacgacaccttggcggggaggctcaccctgtccaccttcacgctggagcagcctctaggccagttcagcagccacaacatctctgacttggataccatctggctggtggtggccctcagcaacgccacccagagcttcacggccccacggacaaaccaggacatccctgctcctgccaacttctcccagaggggctactatctcacactgagggccaaccgggtgctgtaccagaccagaggccagctccatgtcctccgcgtcggcaatgatacccactgccaaccaacaaaaattggctgcaaccatcccctaccaggacccggcccctacagggtgaagttcctggtgatgaatgacgaaggacccgtggctgaaaccaagtggtccagcgacactcgcctgcagcaagcccaggcacttcgggctgtccccggcccccagagcccgggcaccgtggtcatcatcgccatcctgtctatcctcctggccgtcctcctcacggtcctcctggctgtgctcatatacacctgcttcaacagctgcaggagcacttccctatcaggcccagaggaggcagggagtgtgagaagatacaccacgcacctcgcgttcagcactcctgccgagggggcttcctgaggggttccagaggggcccacgtgtccctccacctcctccctggcccaggctgcagagcctgagctgggacacgccctgaagcttctggaccctgagagagattgtttcttttctttactatttttttttttttttttgagacggagtctcactctgtcgccaggctggcgcgatcttggctcactgcaacctctgcctcacgggttcaagcgattttcctgcttcagcctcctgagtagctgggactacaggcacacgccaccatgcccagctcatttttgtatttttagtagagatggggtttcaccatgttggccaggatggcctccgtctcttgaccttgtgatccgcccgactcggcctcccaaaatgctgggattacaggcgtgagccatcaagtctggtgagagagattgtttctagatgagggtgggggcgggtgtccttagcccaaagcttgtgccagtctctatcagaaataaatgcccccaaaacctc

SEQ ID NO: 23047 - DNA, 998 bp, Homo sapiens
ggagtaagagagagagaaagagagacagcactgtgcgtcatgtaccagcgccggaagttggtctcgacacctggactagccgggttgtatttggaaacgcggagtgagtttttccgtgctgtgtaggggctaacaatggacacccagaaggacgttcaacctccaaagcagcaaccaatgatatatatctgtggagagtgtcacacagaaaatgaaataaaatctagggatccaatcagatgcagagaatgtggatacagaataatgtacaagaaaaggactaaaagattggtcgtttttgatgctcgatgaatgctgggaattcagaggaatgtcttcacttatacttggatttgctctcttcccatttctgattgttgtatagctttcgattttgcttacagtagttcccccttatcttcgggagatacattccaaggcccccagtgaactcctgaaacctcaaacagtaccaaacctttatacactgttttttccatatatatatacctatgataaagtataatgtataaattaagcatagcaagagattaataataatgtaatagaacaatgataacatactataataaaagttatgtgaatgtggttggtctctcttgctttcaaaatatcttcttgtacagtactcacctattttagaatgtggttgactacaggtaaccaaaaccacagaaagggaaactttggatgaggggggcactactgtacttaggaatacaactatatacatatgattttatttttaagaccatattatatttgggtatctactaatattttgtataaagcaattttttgttccattacgtgactttttgttttattgtatatgtaatttaacacacaataaagggtaaagttgcttccccaaaccacacttttaatcaaaacctagaatcatctgcagtccttgttaaaaatgcaggtttctagaaccctctgaagttctgattaaataaatttattgcaaacca

SEQ ID NO: 23048 - DNA, 892 bp, Homo sapiens
ccgggccgggccgggcagtctgggacgcgccgccgccatgatcatccctgtacgctgcttcacttgtggcaagatcgtcggcaacaagtgggaggcttacctggggctgctgcaggccgagtacaccgagggggatgcgctggatgccctgggcctgaagcgctactgctgccgccggatgctgctggcccacgtggacctgatcgagaagctgctcaattatgcacccctggagaagtgaccacgctggaacccacccacccgctgtgctgaccatgggccctgagcgtcctgccccgaattcacgaggctgaggcatccgggagctggcgtaatgcctggccgcagtgtgtgtgtatccgataccccactctggaaggaaccatccagtaaaggtctttcagaaccactaaggtcccagccctcactaggatgtcaggagccaggtctaggcccagctttcacactgtggcagcccagtgaagcagactgggccatgaactctcctagccctggggccagcctgttccacaggcacccctgcaggaggcgctgccaggagagccttccatctcggggctctttgaggttccctccttctgggtgttcttcaggctgagcagagaggctcctgtaccctctctctcggaatctgaagagccagatttaggccgggcaaaggggctcacccctataatcccaggactttgggaggccaaggcaggaggatcacttgagtccagaaattcaagacccgcctgggcatcataatgagaccccatctctacaacaaaatttaataaattagctgggcacagtgttcacacctgtagtcccggccactcggggctgaggcaggaggatcactggaacctgggaggttgccactgca

SEQ ID NO: 23049 - DNA, 585 bp, Homo sapiens
agtctgggacgcgccgccgccatgatcatccctgtacgctgcttcacttgtggcaagatcgtcggcaacaagtgggaggcttacctggggctgctgcaggccgagtacaccgagggggatgcgctggatgccctgggcctgaagcgctactgctgccgccggatgctgctggcccacgtggacctgatcgagaagctgctcaattatgcacccctggagaagtgaccacgctggaacccacccacccgctgtgctgaccatgggccctgagcgtcctgccccgaattcacgaggctgaggcatccgggagctggcgtaatgcctggccgcagtgtatgttggaggcatggtctcgctgcccacaaagagccaccaccgtcttgcagcagctgtctgggaccacacggccaccggcctcctgtgagcggatccactcactgtctcgccagtcctgtgagttgttgctgccacagcagtggaactgcatcaagaacaaggctggggttgagacctggggccagaggctcctgcagaggtccagggaggccctggggatgcacgcgccctcccagcaccacccaccca

SEQ ID NO: 23050 - DNA, 6640 bp, Homo sapiens
gggacactctacggtggccgagaggatgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccagcaggcgcacatccaagttgtgagtaagaacctgtacagccaggacaaccaacatgcccccttgctatatggggtgctcgaccataggatgggtacgagtgagaaggatcgtccatgtgaaacctgtgggaaaaacttggctgactgtctaggccactatgggtatatcgacctggagttgccgtgttttcatgtagggtacttcagagcagtcataggcatcttacagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaaacaaagcaaacatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagcctgtcaccctgtggacgggaaagcagatcttcagtgtcatcctcaggcctagcgatgacaatccagtgagggccaacctgcgaaccaagggcaagcagtactgtggcaaaggggaagatctctgtgccaatgattcctatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggaggcactgatcctgaaggagctgtctgtgatccgtgaccacgctggcagtgcctgcctccgggagctggacaagagcaacagccccctcaccatggctctgtgcggctccaaaggttccttcattaacatatcacagatgattgcctgtgtgggacagcaggccatcagtggctctcgagtgccagacggctttgaaaacaggtccttgcctcattttgaaaaacactcaaagctcccagctgccaaaggctttgtggctaatagcttttattccggtttgacaccaactgagtttttcttccacacaatggccggccgggaaggtctagtcgacacggctgtaaagacagctgaaacgggatacatgcagcgaaggcttgtcaaatctcttgaagatctttgctcccagtatgatctgacagtccgaagctctactggcgatattatccagttcatttatggaggagatggcttagatcctgcagctatggagggaaaagatgaacctttggagtttaaaagggttctggacaacatcaaagcagtcttcccgtgtcccagtgagcctgctctcagcaaaaacgagctgatcctgaccacagagtccatcatgaagaagagtgagttcctctgctgccaggacagcttcctgcaggaaataaaaaaattcattaagggggtctctgagaagatcaagaaaaccagagataaatatggcatcaatgataacggcacaacagagccccgtgtgctgtaccagctggaccgcatcacccccacccaagtagaaaagtttctggagacctgtagggacaagtacatgagggcacagatggagccaggttctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcagcactccaattatcacagcacagctagacaaggatgacgacgcggattatgctcgcctcgtgaaagggagaattgagaaaaccctcttgggagagatttccgagtatattgaagaagtgtttcttcctgatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcgggagagctgagggttttattgtttgcttgcttgaaacctaatctatagacggccccacagctcgtgcacacactgcttccctggacttaaagcccagccaggtgtcatggtccatcccagctcactgcatacatccatcggctccccatggtgtcttcacacctgacgatgagccaggcctgagccccacacaggccagggcacattcttggattttccattccttggtcatgctggaatctctcaatgtgacatacttatgtaaatattgttactattatttatttgttccatttgagggatttggaatttttgttattttagttttatttttgaaaccaagcatctatagaaaccaagaaagtcagcatgtaagcgtcactggaaaaactggtttaagcaaatagagccgtctgggatttgtaactgaggtgcaactgtcatgaggcccaggcagctctgtaacatcttctatagatgcccctggctaccctgttgttttcatctacctcagacccctatcatggggctctaccctgtgacaagagccaaacccattctccatggcctatggaagcctcactggagtttggggcctgctgcaatggggatgagatggttttttgtagaattatacttacgttccttggatgatctctagttgattttttaagttctgagttgatgctgttaaggtacccggggtagccattggttcttggatctgtgttagaatgagtgctttcccttcctactgatgtgattgtggattaggaattcgtgaccgagtgatttttggccagtggttgggtttaaaattctattaaaatttgtagtttgggctgggtgctgtggctcatacctataatcccagcactttgggaggccgaggggggcagatcacttgagcccaggagttcgagagcagcctgggcaacatgacgaaaccccgtctctacagagaatacaaaaattagccaggcatggtggcccatgcctgtagtacctgctattggtaaggctgaggtggaaggttcacttgagcctgggaggtggaggttgtagtgagccaagatcgtgccactacactccagcctgggcaacaaagcaagaccttgtctcaaaaaaaaaaaagaaaaaaattaagcgtaaaaaaaaattagtttttataaaaaattatagtttgaccttttgatttccctgcatctacaaggtagacctattaacttctcttggggtatcagtgatgtggaaaaaaaatgccatttttcttaatgtttaacccccctttatctttgaattgagctagagcctggtttaggacaaaggattaagtttgttaatgaacactaattcagggcttctacttgagaccccaccgagatcaccagttctcatgtaacctgggaagagccataaaggggtaccccccaccccaactgccttcctggaagcatgcctgggaagtaagctgtaggcctgatccgagccaggaccactgggatccgtgcaaaggccaggggagggtagaattgaatcataggagtgaactccggcacctgttgtcttctgcgggtgacgcacactttaaatggaagagaggttgtggctataacttgtggctgggaataataaagatggcaccgccaaggagcctcaccttgcgtgagtgagtactcagttgggcgctgcagggtctggagtctgtgtgagacgtgtgtgattgtgatgggtgcgaatcagcgtatagcacttgagaacaaggcagaccttggagcagaatggttatgtgaaggatcacatcacccatgggtagggggggaagtcatacgtcctggaggtgctggtcctcctcctggaactgccagccttgctaggactatcaacatcaacagcattgcctggtaaaccctactgtttgtgctccccactgtgtcccatgactggtgttaaaattctccctactttgatcatctgccctgcccaggccttgggctttatgccagcacagagctcaaaggccaggtagcagcacatcctcaagcatgagagctcaaagggttacatttgagtctctgtacctgcttggaagaaataaaaatacgtgtgaattccatctca

SEQ ID NO: 23051 - DNA, 1668 bp, Homo sapiens
ctgcagtgggtgctctgtgtgcccagagcattggtgagccaggcacccagatgaccctgaagactttccactttgcaggtgtggcctccatgaacatcaccctgggcgtgccccggattaaagagatcatcaacgcttccaaggccatcagcactccaattatcacagcacagctagacaaggatgacgacgcggattatgctcgcctcatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtgcctggccccaaccctgagacctgtatgaaggtggatagtccacactcagaaaagagaagcaggatggtagtcatggaagctggaatctgccaaggagtatggaacaactcaccagccaaatgaactcgtcctaaaaatatggatctaatttttttaaaaaagaaaaggccaagtgcagtggctcacacccataatcccagcatcccagcacttgggaggccgaggtagatggatcacttgaggtcaggagttcgagatcagcctggccaacatggtgacaccccatctctactaaagatacaaaaattagccaggcatggtggcatgtgcctgtagtcccagctactcgggaggctgaagcatgagaatcgcttggacctgggaggcagaggctgcggtgagccaaaattgcgccaatgcactccagcctgggtgacagaagaagaccctgtttcagggggaaaaaaaagaaaaagaaaggaaagggaaaaaacatgaagagagcccagtgtatccagacccgagtctcatcaccttctcaggaagctttttgggttgtccaggccttaagtaggcctgtgcttccaaacttcatttctgggaggagtgccagtgggctggggaagtcggaggctagaagaagcctgttcttgtaccttgcagtctgttccaccaccgaggaacaggcctgacccgagtggcctgcagtaaagctccgagtcagggagcatggtataatcacctgacactggtgttacaggtaaatcacaatctctccccatagacaacatgatcttcctcatgt

SEQ ID NO: 23052 - DNA, 4433 bp, Homo sapiens
atgccgcagatgtgttagcggcgagtccagaagcagccccaggaggtgctgggggcatcgtttctctaatctggcctcccgagtgccaaggaggcgtcccggcagcggtcatcatggtgaaggagcagttccgggagacggatgtggccaagaaaataagccacatctgttttggaatgaagtcacctgaggagatgcgccagcaggcgcacatccaagttgtgagtaagaacctgtacagccaggacaaccaacatgcccccttgctatatggggtgctcgaccataggatgggtacgagtgagaaggatcgtccatgtgaaacctgtgggaaaaacttggctgactgtctaggccactatgggtatatcgacctggagttgccgtgttttcatgtagggtacttcagagcagtcataggcatcttacagatgatctgcaaaacctgctgccacatcatgctgtcccaagaggagaagaagcagtttctggactatctaaagaggcccggcctgacctaccttcagaagcgaggactgaaaaagaaaatctctgacaagtgccggaagaaaaacatctgccatcactgtggcgcttttaatggtaccgtaaagaagtgtggactgctgaaaataattcatgagaaatacaagaccaacaaaaaagtggtggatcccattgtatcaaatttccttcagtcttttgaaacagccattgaacataataaagaagtggagcctctgctgggaagggcacaggaaaacttgaatcccttagtagttctgaatttatttaaacgaatcccagctgaagatgttcctctacttctgatgaacccagaagccggaaagccgtctgatttgattctcacacgacttttggtgcctcctttgtgtatcagaccctccgttgtgagtgatttgaagtctggcaccaatgaagatgatctgacaatgaaactgacagaaatcattttcctaaacgatgttattaaaaagcatcggatctcaggagccaagacccagatgatcatggaggactgggatttcctgcagctgcagtgtgccctctacattaacagtgagctctcgggcattcccctcaacatggcacccaagaagtggaccagaggcttcgtccaacgcctgaagggaaaacagggtcgatttagaggaaatctctcaggaaagagagtggatttttctggcagaacagtcatctcgcccgaccccaacctccggattgatgaggtagctgtgccagttcatgtggccaaaattctaacttttcctgagaaggtaaacaaagcaaacatcaatttcttgaggaaactggttcaaaacggccctgaggttcacccaggagcaaacttcattcagcagagacatacgcagatgaaaaggtttttgaaatacggaaatcgagaaaagatggctcaagagctcaagtatggtgacatcgtagagagacacctcatcgatggagatgtggtgctgttcaatcggcagccctcgctgcacaaattgagcattatggctcatctggccagggtcaagccccaccggaccttcagatttaatgagtgtgtctgtacaccctataatgctgactttgatggtgatgaaatgaaccttcatcttcctcaaacagaagaagctaaagcagaggcccttgttctgatggggactaaagcaaatcttgtaaccccgaggaatggggaaccgctgattgctgctattcaggattttctaacaggtgcctatctcctcactctcaaggacactttctttgatcgagccaaggcttgccaaatcattgcttcaatactggttggcaaggatgagaaaattaaagttcgcctcccaccgcctacaatcctaaagcctgtcaccctgtggacgggaaagcagatcttcagtgtcatcctcaggcctagcgatgacaatccagtgagggccaacctgcgaaccaagggcaagcagtactgtggcaaaggggaagatctctgtgccaatgattcctatgttacaatccagaacagtgagttgatgagtggcagcatggacaaaggaaccctagggtcaggatccaagaacaatattttttacattttgctgcgagactggggacagaatgaagctgcagatgccatgtcacggctcgccaggctggctcctgtctacctgtctaaccgtggtttctcaattgggatcggtgatgtcacacctggccaaggactgctgaaggccaagtatgagttgctgaatgccggctacaagaaatgtgatgagtacatcgaagccctgaacacgggcaagctgcagcagcagcctggctgcactgctgaggagaccctggaggcactgatcctgaaggagctgtctgtgatccgtgaccacgctggcagtgcctgcctccgggagctggacaagagcaacagccccctcaccatggctctgtgcggctccaaaggttccttcattaacatatcacagatgattgcctgtgtgggacagcaggccatcagtggctctcgagtgccagacggctttgaaaacaggtccttgcctcattttgaaaaacactcaaagctcccagctgccaaaggctttgtggctaatagcttttattccggtttgacaccaactgagtttttcttccacacaatggccggccgggaaggtctagtcgacacggctgtaaagacagctgaaacgggatacatgcagcgaaggcttgtcaaatctcttgaagatctttgctcccagtatgatctgacagtccgaagctctactggcgatattatccagttcatttatggaggagatggcttagatcctgcagctatggagggaaaagatgaacctttggagtttaaaagggttctggacaacatcaaagcagtcttcccgtgtcccagtgagcctgctctcagcaaaaacgagctgatcctgaccacagagtccatcatgaagaagagtgagttcctctgctgccaggacagcttcctgcaggaaataaaaaaattcattaagggggtctctgagaagatcaagaaaaccagagataaatatggcatcaatgataacggcacaacagagccccgtgtgctgtaccagctggaccgcatcacccccacccaagtagaaaagtttctggagacctgtagggacaagtacatgagggcacagatggagccaggttctgcagtgggtgctctgtgtgcccagaggaacatcaccctgggcgtgccccggattaaagagatcatcaacgcttccaaggccatcagcactccaattatcacagcacagctagacaaggatgacgacgcggattatgctcgcctcgtgaaagggagaattgagaaaaccctcttgggagagatttccgagtatattgaagaagtgtttcttcctgatgactgctttattctcgtcaagctctccctggaacggattaggcttctgagactggaagtgaacgctgagacagtgagatattccatctgcacatccaagctccgtgtgaagcccggtgatgtggctgttcatggtgaggctgtggtgtgtgtcacccccagagagaacagcaagagctccatgtactacgtgctgcagttcctgaaagaggatctccccaaggtggtggtgcagggcattccagaggtgtccagagctgtcatccacattgacgagcagagtggaaaggagaagtacaagcttctggtggaaggtgataacctgcgggcagtcatggccacacacggtgtgaagggcacccgaaccacctccaataacacctatgaggtggagaaaactctgggcatcgaggccgcccggacaacgatcatcaatgaaatccagtacaccatggtgaaccacggcatgagcatcgacaggaggcacgtgatgctgctctccgacctcatgacctacaagggtgaagtcctgggcatcactaggtttggcctggccaagatgaaggagagtgtgctgatgctggcctcctttgagaagacggctgaccatctctttgacgctgcctacttcgggcagaaggactctgtgtgtggggtgtctgagtgcatcatcatgggaatcccaatgaacattggaaccgggctcttcaagctgcttcacaaggctgacagggacccgaaccctcccaagaggcccctgatcttcgacacaaatgaattccacatcccccttgtcacatagtccaaagaaagaggggaccatgcctgaccttgactccttgtcctgtctccagctgatgtataaagagttttgtgctccctgggacgggggtcctgaggtccccacctatgccagcaatcagagaagccctcttggcatccccaggagcagcttctcctctgatagggtgcagctcacaccagtgaccctgactgtgccacgctgctcggg

SEQ ID NO: 23053 - DNA, 4273 bp, Homo sapiens
accagagggcgtactttccttactcggcctcggccacatccgggttccaccgcagattcgggcagggagcgggcggaacctttctaccgcgtctctagctaacacgcacggcggggacagtttaggcctccgcgcaccgttcgccgggagtcttgcagtttgcttggtgcagggaaggcgggcgcggaggttctatctgtttcttcctccttcgtgagcagcatggacgtgctagcggaggagtttgggaacctgactccggagcagctggcggcgccgatcccgactgtagaggaaaaatggaggctgcttccagcatttttaaaggtgaaaggccttgtgaaacagcatatagattcatttaactatttcattaatgtagagataaagaagataatgaaagccaatgaaaaggttacaagtgacgctgaccctatgtggtacttaaaatatcttaatatctatgttgggcttcctgatgttgaagaaagcttcaatgtaactagaccagtgtcccctcatgagtgccgtttgagagacatgacatactctgcccctattacagtggatattgaatatacccgaggcagccagaggatcatccgcaatgccttacctatcggcagaatgcccataatgctacgtagttcaaactgtgttcttacaggaaaaacgccagcagaatttgccaaactgaacgaatgtcccttagatccaggtggctacttcattgttaaaggagtagaaaaagttattcttatccaagagcagctgtctaagaacaggatcatcgtggaggctgatagaaaaggggctgttggagcttcagttaccagctctacccatgagaaaaaaagcagaaccaatatggctgtgaaacaaggacgattttatttgaggcataatactttgtcagaagatatacccattgtcatcatatttaaggccatgggtgttgagagtgaccaggaaattgtgcagatgattggaacagaggagcacgtgatggctgcatttgggcccagtctggaagagtgccagaaagctcagattttcacacagatgcaggcattaaaatatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcaccaatggcatggtgaatgctatttctaccggaaattggtctttaaagagatttaaaatggaccgccagggtgtaacccaagtgctgtctcgcttgtcatatatatccgcactgggcatgatgacaagaatctcttcccagtttgaaaaaacgagaaaagtgagtggtcctcgctccctccagccatctcagtggggaatgctgtgtccttcggacactcctgaaggagaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtaacatcttaggtgtcattcgagaccacaaaaagctagtgaatacatttcgactcatgagaagagcaggatatatcaatgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacaggaattttgaagatttcttacatgagagtctggttgaatatttagatgtgaatgaagaaaatgattgtaacattgcactgtacgaacacacaattaataaagacaccacccacttggagattgaacccttcactcttctcggcgtgtgtgctggacttatcccataccctcaccataaccagtcaccgagaaacacttatcagtgtgccatggggaaacaagccatgggtactataggatacaaccagcgaaacagaattgatactctcatgtatctactagcatatccacaaaaacccatggttaagacaaaaaccattgaattgatagaatttgagaaactgccagctggacagaatgcaacagttgctgtgatgagctatagtggctatgatattgaagatgctcttgttttaaacaaggcctctttagacagaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtgagaaagtagaaaacaaacaagtgcttgtaaataagtccatgcccacagtgactcagattcctttggaaggaagtaatgtaccacagcaaccacagtacaaagatgtacccataacctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtgtttgtggcttgatcgtcccccaggaagacatgccattttgtgattctggcatctgtccggacatcatcatgaacccacacggcttcccatcacgaatgacggtggggaagctcattgagctgctggctggcaaggccggtgtgctggacggcagattccactacggcactgcgtttggaggcagtaaagtgaaggatgtgtgtgaggacctcgttcgccatggttataactacttggggaaagactatgttacatccggcatcacaggtgagcccttagaagcatacatctattttggccccgtgtactatcagaagctgaaacacatggtgctagataaaatgcatgcccgggcccggggcccacgagccgtccttaccaggcaacccactgaaggacggtctcgtgatggtggcttgcgtctcggggaaatggaacgtgactgtttaatcggttatggagccagtatgcttttgctagagagactaatgatttcaagtgatgcctttgaggttgatgtctgtgggcagtgtggacttctggggtattctggctggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgcaatactattcgttaaatatctgaatctaa

SEQ ID NO: 23054 - DNA, 4118 bp, Homo sapiens
agagcgtcgcgcttgcgagtcttttttccagagccggcctccgcgtgcgcgagtgaaggctgatcccagaggagctgtcagccgctgcgggggccgagaagccccgctgctggctctagggttggagctcttccagcataggaaaaatggaggctgcttccagcatttttaaaggtgaaaggccttgtgaaacagcatatagattcatttaactatttcattaatgtagagataaagaagataatgaaagccaatgaaaaggttacaagtgacgctgaccctatgtggtacttaaaatatcttaatatctatgttgggcttcctgatgttgaagaaagcttcaatgtaactagaccagtgtcccctcatgagtgccgtttgagagacatgacatactctgcccctattacagtggatattgaatatacccgaggcagccagaggatcatccgcaatgccttacctatcggcagaatgcccataatgctacgtagttcaaactgtgttcttacaggaaaaacgccagcagaatttgccaaactgaacgaatgtcccttagatccaggtggctacttcattgttaaaggagtagaaaaagttattcttatccaagagcagctgtctaagaacaggatcatcgtggaggctgatagaaaaggggctgttggagcttcagttaccagctctacccatgagaaaaaaagcagaaccaatatggctgtgaaacaaggacgattttatttgaggcataatactttgtcagaagatatacccattgtcatcatatttaaggccatgggtgttgagagtgaccaggaaattgtgcagatgattggaacagaggagcacgtgatggctgcatttgggcccagtctggaagagtgccagaaagctcagattttcacacagatgcaggcattaaaatatatagggaacaaagtaagaaggcaaaggatgtggggaggtggaccaaagaaaaccaaaatagaagaagcaagagagctcctggcttccaccattctgacccatgtcccagttaaggaattcaatttccgagccaaatgtatctatactgcagtgatggtgcgaagagttattctggcccaaggagataataaagttgacgacagagattattatggtaacaagcgactggaattggcaggacagcttttatctcttctttttgaagacttgttcaaaaaatttaattctgaaatgaaaaagattgccgaccaggtgattcctaagcaaagagcagcccagtttgatgttgtcaaacacatgcgccaagaccagatcaccaatggcatggtgaatgctatttctaccggaaattggtctttaaagagatttaaaatggaccgccagggtgtaacccaagtgctgtctcgcttgtcatatatatccgcactgggcatgatgacaagaatctcttcccagtttgaaaaaacgagaaaagtgagtggtcctcgctccctccagccatctcagtggggaatgctgtgtccttcggacactcctgaaggagaggcatgtggtttggttaaaaacttggcccttatgacacacatcacaactgatatggaagatggacccattgttaaattagccagtaacttgggagtagaagatgtgaatttattatgtggggaagagctctcttacccaaatgtgtttcttgtctttcttaatggtaacatcttaggtgtcattcgagaccacaaaaagctagtgaatacatttcgactcatgagaagagcaggatatatcaatgaatttgtttccatctcaacaaatcttacagatcgatgtgtctatatttcttctgatgggggaaggctatgcagaccctacataattgtcaagaaacagaagccagcagtcacaaataaacatatggaagagctggcccaagggtacaggaattttgaagatttcttacatgagagtctggttgaatatttagatgtgaatgaagaaaatgattgtaacattgcactgtacgaacacacaattaataaagacaccacccacttggagattgaacccttcactcttctcggcgtgtgtgctggacttatcccataccctcaccataaccagtcaccgagaaacacttatcagtgtgccatggggaaacaagccatgggtactataggatacaaccagcgaaacagaattgatactctcatgtatctactagcatatccacaaaaacccatggttaagacaaaaaccattgaattgatagaatttgagaaactgccagctggacagaatgcaacagttgctgtgatgagctatagtggctatgatattgaagatgctcttgttttaaacaaggcctctttagacagaggctttgggcgttgccttgtatataaaaatgctaaatgtacgttgaaacgatacaccaatcagacttttgataaagtgatggggcccatgttggatgctgctacaaggaaacctatctggcgacatgaaatcttagatgcagatggtatttgttctccaggtgagaaagtagaaaacaaacaagtgcttgtaaataagtccatgcccacagtgactcagattcctttggaaggaagtaatgtaccacagcaaccacagtacaaagatgtacccataacctacaaaggagcaacagactcatatattgaaaaagtgatgatatcttcaaatgctgaagatgcttttctgatcaaaatgctgctgagacagacaaggcgtccagaaattggagacaaattcagcagtcgtcatgggcaaaaaggtgtttgtggcttgatcgtcccccaggaagacatgccattttgtgattctggcatctgtccggacatcatcatgaacccacacggcttcccatcacgaatgacggtggggaagctcattgagctgctggctggcaaggccggtgtgctggacggcagattccactacggcactgcgtttggaggcagtaaagtgaaggatgtgtgtgaggacctcgttcgccatggttataactacttggggaaagactatgttacatccggcatcacaggtgagcccttagaagcatacatctattttggccccgtgtactatcagaagctgaaacacatggtgctagataaaatgcatgcccgggcccggggcccacgagccgtccttaccaggcaacccactgaaggacggtctcgtgatggtggcttgcgtctcggggaaatggaacgtgactgtttaatcggttatggagccagtatgcttttgctagagagactaatgatttcaagtgatgcctttgaggttgatgtctgtgggcagtgtggacttctggggtattctggctggtgccattactgcaagtcatcctgccacgtgtcttccctccgtattccgtatgcctgcaagctgctcttccaggaactacagtctatgaacatcatccccaggttaaaactgtccaagtacaatgaatgaggatggaaaaaatgattattaaagagaacaagtgatacatccaatgcaacggaaagcagaagggatttaggactacgtctcctcctgtgaagaattcccttgcgtattctctctctaaaacaaccaaaaaaaaatggagaggctttttatatactctaagactggctaaacaaccttgatcattgagcctcgagccatgggagagatgctgaccatgtggactgcaaggctgcttgattcacagatggatgtgacctaaaggataaataagctattacttatgtgctgatctcttgacattcactcattagaagaccttactccttcaagcaaatgtttggggtcaaatttaccatatcttctggctaaccatattcaagattcttctgaaacttggaggatgtaaagaatccatttgatttggtcagcctggcttttgtcgtggtggctggctcggataaattttcccaacaattaaatcttgcctttacacacccaaactttgtaattttagtcttggtgaaatataatgaatttgttcctaccttgtcaagcaagaatgtcgtcttctcctatggactcaattgctattattttaaacctgcatgattgtaccatgcaatactattcgttaaatatctgaatct

SEQ ID NO: 23055 - DNA, 3800 bp, Homo sapiens
ggcgcgggcgcatgcgcaggcgcgggccggtggggtggcctggagcggcgtgcgtaatgtcggcactttgctggggccgcggagcggcggggctcaaacgagccctacggccttgcggccgcccgggactccccggcaaagaagggaccgccggtggcgtctgcggccccaggaggagctcgtccgccagcccccaggagcaagaccaagaccgcaggaaggactggggccacgtggagctgctggaggtgctccaggcgcgggtgcggcagctgcaggctgagagcgtgtcggaggtggtggtgaacagggtggatgtggcgcggctcccagaatgtggcagtggagatggtagcctccagccacccaggaaggtccagatgggggccaaggatgccaccccggtgccctgtggccgctgggcaaagatactggagaaggataagcggacccagcagatgcgtatgcagcggttgaaggcgaagctgcagatgccattccagagcggggagttcaaggcgctgaccaggcgcctgcaggtggagccccggctcctgagcaagcagatggccgggtgcctggaggactgcacgcgccaggcccccgagagcccctgggaggagcagctggcccggctgctgcaggaggcccctgggaagctgagcctcgatgtggagcaggccccgtcggggcagcactcgcaggcccagctctcaggtcagcagcagaggctcctggccttcttcaagtgctgcctgctcactgaccagctgcccctcgcccaccacctgctggtcgtccaccacggccagcggcagaagcggaagctgctcacgctggacatgtacaacgccgtgatgcttggctgggcgcggcagggtgccttcaaggagctggtatatgtgttattcatggtgaaggatgccggcttgactccggacctgctgtcctatgcggctgccctccagtgcatggggaggcaggaccaggacgccgggaccatcgaaaggtgtctggaacagatgagccaggaggggctgaagctgcaggcactcttcaccgccgttctgctgtctgaggaggatcgggccactgttctgaaggccgtgcacaaggtgaagcccaccttcagcctcccgccgcagctgccgcccccggtcaacacctccaagctgctcagggacgtgtatgccaaggatgggcgtgtgtcctacccgaagctgcacctgcccttgaagaccctgcagtgcctctttgagaagcagctccacatggagctggccagcagggtgtgcgtggtgtccgtggagaagcccacgttgccaagcaaggaggtcaagcacgcgcggaagaccctgaagaccctgcgggaccaatgggagaaagcactgtgccgggcgctgcgggagaccaagaaccgcctagagcgcgaggtgtacgagggccggttctcactttaccccttcctgtgcctgctggacgagcgcgaggtggtgcggatgctcctgcaggtcctgcaggcgctgcccgcccaaggtgagtccttcaccaccctggcccgggagctgagtgcgcgcactttcagccggcacgtggtgcagaggcagcgggtcagtggccaggtgcaggcgctgcagaaccactacaggaagtacctctgcttgctggcctccgacgccgaggtgcccgagccctgcctgccgcggcagtactgggaggagctgggggcgcccgaggccctgcgggagcagccctggcccctgccagtgcagatggagctgggcaagctgctggcggagatgctggtgcaggctacgcagatgccatgcagcctggacaagccgcatcgttcctctcggcttgtccccgtgctctaccacgtgtattccttccgcaacgtccagcagatcggcatcctgaagccgcacccggcctacgtgcagctgctggagaaggccgcggagcccacgctgaccttcgaggcggtggatgtacccatgctttgccccccgctgccctggacatcgccgcactctggtgctttcctgctcagccccaccaagctgatgcgcacggtggaaggcgccacgcagcaccaggagctgctggaaacctgcccgcccaccgcgctgcatggcgcactggacgccctcacccaactgggcaactgcgcctggcgcgtcaacgggcgcgtgctggacctggtgctgcagctcttccaggccaagggctgcccccagctaggcgtgccggccccgccctccgaggcgccccagccgcccgaggcccacctgccgcacagcgccgcgcccgcccgcaaggccgagctgcgccgtgagctggcgcactgccagaaggtggcccgggagatgcacagcctgcgggcggaggcgctgtaccgcctctcgctggcgcagcacctgcgggaccgcgtcttctggctgccgcacaacatggacttccgcggccgcacctacccctgcccgccgcacttcaaccacctgggcagcgacgtggcgcgggccctgctggagttcgcccagggccgcccgctcggcccgcacggcctggattggctcaagatccacctggtcaatctcacggggttgaagaagcgggagccgctgcggaagcgcctggcctttgcggaggaggtgatggatgacatcctggactccgcggaccaacccttgacgggccgaaagtggtggatgggcgcggaggaaccctggcagacgctggcctgctgtatggaggtggcgaacgctgtgcgcgcctccgaccctgccgcctatgtctcccacctccccgtccatcaggacggctcttgcaacggcctgcagcattatgctgctctgggccgcgacagcgtgggcgccgcctccgtcaacctggagccctcggatgtgccgcaggacgtgtacagcggcgtggccgcgcaggtggaggtgttccgtaggcaggacgcccagcggggcatgcgggtggcacaggtgctggaaggtttcatcacccgcaaggtggtgaagcagacggtgatgacggtggtgtacggggtcacgcgctatggcgggcgcctgcagattgagaagcgcctccgggagctgagcgactttccccaggagttcgtgtgggaggcctctcactatctcgtacgccaggtcttcaagagtctacaggagatgttctcggggacccgggccatccagcactggctgaccgagagtgcccgcctcatctcccacatgggctctgtggtggagtgggtcacacccctgggcgtccccgtcatccagccctatcgcctggactccaaggtcaagcaaataggaggtggaattcagagcatcacctacacccacaacggagacatcagccgaaagcccaacacacgtaagcagaagaacggcttcccgcccaacttcatccactcgctggactcctcccacatgatgctcaccgccctgcactgctacaggaagggcctgaccttcgtctctgtgcacgactgttactggactcacgcagctgatgtctccgtcatgaaccaggtgtgccgggagcagtttgtccgcttgcacagcgagcccatcctgcaggacctgtccagattcctggtcaagcggttctgctctgagccccagaagatcttggaggccagccagctgaaggagacactgcaggcggtgcccaagccaggggccttcgacctggagcaggtgaagcgttccacctacttcttcagctgacaccccgtgagccttgtcagtgtgtaaataaagctcttttgccacccccag

SEQ ID NO: 23056 - DNA, 3633 bp, Homo sapiens
aatcagcgatcagactccggagtttggcccgggagctggggagctcaccgatcccccgcccagcagttctggccgctgtcccggtgcgcacggacgtggctcgagtttcctctgctctccgctctcgcccgctagctctcctcccttccgctcctgcttctctccgggtctcccgctccagctccagccccacccggccggtcccgcacggctccgggtagccatggaggaccccacgctctatattgtcgagcggccgcttcccgggtaccccgacgccgaggccccggagccttcctccgctggggctcaggcagcggaggagccgtcgggggccggctcagaagagctgatcaagtcggaccaggtgaacggcgtgctggtgctgagcctcctggacaaaatcatcggggccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgttaggacccgatggggaggcagcccccgcagtggacaacccccgcttggacacagtccgagtggaatgggaagggaatggtcaatccctgtcctggttgtccaagtcgggatctcagaggaaattgcagtgattccacggttaggcccccctgggggggctgccttcccctcagcctctccccacaccacccacccagctgctgtcattccgctcactgagctcttcttcattctcaccctgatccctgggggactcaaagccaaaactgcccaaagaggaaagattgaatcctaaaggggatccctgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttatgcctgtaaccccagcactttgggaggccgaggtgggcggatcacctgaagtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaaggaaaaaaaaggaaaataggagaaggtggaaatgggtgaagagagaagtcccctcactagctgcatgagaaatctatcttactgtggttctccatgggcagcaggaccatttttcagaatcaagagggaggacagtgtgagaaggcgatgatccaaagaagacagagaggtcagccccacccgatccctcaaatgggctcttggaggcacccccaggggcagcccatttctcaaagtccagaaaattagggtcccagaagggggcagcagcaggctgggagttaggagggagagcagggtgccggccctgccaccaagttgagagctggaggggaggtggggagagaacatcacagagcagccagccctggttcactcctggcagtttcttctcaagctccttccctaggagcatggtggcacgtgcctgtggtctcagctacttgggaggctgaggcgggaggatcgccagagcccaggagtttgaggctgcagtgagctatgagggtgcctctgtgctccatcctaggcaacagagtgatacgctgtttaaaaaggaaaaaatccttccctagagctagtatcctaaagctgcagagctagcccagacctcattggtttccttgtccttggggtgcttttcctgaatctttgcgggtgaagggagtgttgctcccagtccagaggcctgattctgtttggactgggttctcaagacacgaccaggttctcaagacacgagtccccttgttcctccccattaaagggggtttgtcagaagcaagaacagcccctctccccagtcacagcctgaagggaggccccgagagcttcctccttccccccacctgctccttaccttctctgccctgctttttagaactgcagttcattgttttaagggattgggggagggagcctggggacacaaaccttttatacaatacaaagctttgctttttttttttttttcttccttttccctttctcggttctcttctctcctctgaatggctgaagacccctctgccgagggaggttggggattgtgggacaaggtcccttggtgctgatggcctgaaggggcctgagctgtgggcagatgcagttttctgtgggcttggggaacctctcacgttgctgtgtcctggtgagcagcccgaccaataaacctgcttttctaaaagg

SEQ ID NO: 23057 - DNA, 1927 bp, Homo sapiens
atggaggaccccacgctctatattgtcgagcggccgcttcccgggtaccccgacgccgtagaccagatccagctgactcaagcacagctggaggagcggcaggcggagatggagggcgcagtgcagagcatccagggcgagctgagcaagctgggcaaggcgcacgccaccacgagcaatacggtgagcaagctgctggagaaggtgcgcaaggtcagcgtcaacgtgaagaccgtgcgcggcagcctggagcgccaggcggggcagatcaagaagctggaggtcaacgaggccgagctgctgcggcgccgcaactttaaagtcatgatctaccaggatgaagtgaagctgccggccaaactgagcatcagcaaatcgctgaaagagtcggaggcgctgccagagaaggagggcgaggagctgggcgagggcgagcggcccgaggaggacgcagcggcgctggagctttcgtcggacgaggcggtggaggttgaggaggttattgaggagtcccgcgcagagcgtatcaagcgcagcggcctgcggcgcgtggacgacttcaagaaggccttctccaaggagaagatggagaagaccaaggtgcgtacccgcgagaacctggagaagacgcgcctcaagaccaaggaaaacctggagaagacgcggcacaccctggagaagcgcatgaacaagctgggcacgcgcctggtgcccgccgagcggcgcgagaaactgaagacgtcgcgggacaagttgcgcaaatccttcacgcccgaccacgtggtgtacgcgcgctccaagaccgcggtctacaaggtgccacccttcaccttccacgtcaagaagatccgcgagggccaggtggaagtgctcaaggccaccgagatggtggaggtgggcgccgacgacgacgagggcggcgcggagcgcggggaggccggcgacctgcggcgcgggagcagccccgacgtgcacgcgctgctggagatcaccgaggagtcggacgccgtgctggtggacaagagcgacagcgactgagccgcccccgctgccacccaccccattcctcgctccttccgaacttcctctttcgcattctctctcggctcgagctggctgagatttttctaaattgaaaacacgcccccctccccacacctccaggaactccactcccagtcttagagctgccttcccctcagcctctccccacaccacccacccagctgctgtcattccgctcactgagctcttcttcattctcaccctgatccctgggggactcaaagccaaaactgcccaaagaggaaagattgaatcctaaaggggatccctgcccccatgggaggccccctactagaaggacgtgaaagcagcttttgggggaaactgaggcagtggggaagacagagcagaatgagccctcaccctggctgggggtccagcacaggctgtatctgcagagggtcccagaggaacgctggagccaagagaagccctgggaaggaggggtggggaacgacatgcatgtgagggatggcacactgatgtgtttatgcacctgtacacaggagcgcatggccatggctttggaaaggagaatggaaaaatagaagaaggtcggccgggcttggtggcttatgcctgtaaccccagcactttgggaggccgaggtgggcggatcacctgaagtcaggagttcgggaccagcctggcaaacaccccatctctactaagcgaaaacccatctctactaaaattacaaaaattagctgggcatggttgcgcatgcctgtaatcccagctactttggaggctgaggtggggagaattgcttgaacctgggaggtggaggttgcagtgagccaaggtcgcgacactgcactccagcctgggtgacagagtgagactccatctcaacagaagg

SEQ ID NO: 23058 - DNA, 4279 bp, Homo sapiens
gagcagagtttcagttttggcagcagcgtccagtgccctgccagtagctcctagagaggcaggggttaccaactggccagcaggctgtgtccctgaagtcagatcaacgggagagaaggaagtggctaaaacattgcacaggagaagtcggcctgagtggtgcggcgctcgggacccaccagcaatgctgctcttcgtgctcacctgcctgctggcggtcttcccagccatctccacgaagagtcccatatttggtcccgaggaggtgaatagtgtggaaggtaactcagtgtccatcacgtgctactacccacccacctctgtcaaccggcacacccggaagtactggtgccggcagggagctagaggtggctgcataaccctcatctcctcggagggctacgtctccagcaaatatgcaggcagggctaacctcaccaacttcccggagaacggcacatttgtggtgaacattgcccagctgagccaggatgactccgggcgctacaagtgtggcctgggcatcaatagccgaggcctgtcctttgatgtcagcctggaggtcagccagggtcctgggctcctaaatgacactaaagtctacacagtggacctgggcagaacggtgaccatcaactgccctttcaagactgagaatgctcaaaagaggaagtccttgtacaagcagataggcctgtaccctgtgctggtcatcgactccagtggttatgtaaatcccaactatacaggaagaatacgccttgatattcagggtactggccagttactgttcagcgttgtcatcaaccaactcaggctcagcgatgctgggcagtatctctgccaggctggggatgattccaatagtaataagaagaatgctgacctccaagtgctaaagcccgagcccgagctggtttatgaagacctgaggggctcagtgaccttccactgtgccctgggccctgaggtggcaaacgtggccaaatttctgtgccgacagagcagtggggaaaactgtgacgtggtcgtcaacaccctggggaagagggccccagcctttgagggcaggatcctgctcaacccccaggacaaggatggctcattcagtgtggtgatcacaggcctgaggaaggaggatgcagggcgctacctgtgtggagcccattcggatggtcagctgcaggaaggctcgcctatccaggcctggcaactcttcgtcaatgaggagtccacgattccccgcagccccactgtggtgaagggggtggcaggaggctctgtggccgtgctctgcccctacaaccgtaaggaaagcaaaagcatcaagtactggtgtctctgggaaggggcccagaatggccgctgccccctgctggtggacagcgaggggtgggttaaggcccagtacgagggccgcctctccctgctggaggagccaggcaacggcaccttcactgtcatcctcaaccagctcaccagccgggacgccggcttctactggtgtctgaccaacggcgatactctctggaggaccaccgtggagatcaagattatcgaaggagaaccaaacctcaaggtaccagggaatgtcacggctgtgctgggagagactctcaaggtcccctgtcactttccatgcaaattctcctcgtacgagaaatactggtgcaagtggaataacacgggctgccaggccctgcccagccaagacgaaggccccagcaaggccttcgtgaactgtgacgagaacagccggcttgtctccctgaccctgaacctggtgaccagggctgatgagggctggtactggtgtggagtgaagcagggccacttctatggagagactgcagccgtctatgtggcagttgaagagaggaaggcagcggggtcccgcgatgtcagcctagcgaaggcagacgctgctcctgatgagaaggtgctagactctggttttcgggagattgagaacaaagccattcaggatcccaggctttttgcagaggaaaaggcggtggcagatacaagagatcaagccgatgggagcagagcatctgtggattccggcagctctgaggaacaaggtggaagctccagagcgctggtctccaccctggtgcccctgggcctggtgctggcagtgggagccgtggctgtgggggtggccagagcccggcacaggaagaacgtcgaccgagtttcaatcagaagctacaggacagacattagcatgtcagacttcgagaactccagggaatttggagccaatgacaacatgggagcctcttcgatcactcaggagacatccctcggaggaaaagaagagtttgttgccaccactgagagcaccacagagaccaaagaacccaagaaggcaaaaaggtcatccaaggaggaagccgagatggcctacaaagacttcctgctccagtccagcaccgtggccgccgaggcccaggacggcccccaggaagcctagacggtgtcgccgcctgctccctgcacccatgacaatcaccttcagaatcatgtcgatcctggggccctcagctcctggggaccccactccctgctctaacacctgcctaggtttttcctactgtcctcagaggcgtgctggtcccctcctcagtgacatcaaagcctggcctaattgttcctattggggatgagggtggcatgaggaggtcccacttgcaacttctttctgttgagagaacctcaggtacggagaagaatagaggtcctcatgggtcccttgaaggaagagggaccagggtgggagagctgattgcagaaaggagagacgtgcagcgcccctctgcacccttatcatgggatgtcaacagaatttttccctccactccatccctccctcccgtccttcccctcttcttctttccttccatcaaaagatgtatttgaattcatactagaattcaggtgctttgctagatgctgtgacaggtatgccaccaacactgctcacagcctttctgaggacaccagtgaaagaagccacagctcttcttggcgtatttatactcactgagtcttaacttttcaccaggggtgctcacctctgcccctattgggagaggtcataaaatgtctcgagtcctaaggccttaggggtcatgtatgatgagcatacacacaggtaattataaacccacattcttaccatttcacacataagaaaattgaggtttggaagagtgaagcgtttttctttttcttttttttttttgagacggagtctctcactgtcgcccaggctggagtgcagtggcgcaatctcggctcactgcaacctccgcctcccaggttgacaccattctcctgcctcaccctcccaagtagctgggactacaggcgcctgccagcacgcctggctaattttttgtatttttagtagagacagggtttcaccgtgttagccaggatggtctcgatctcctgacctcgtgatccgcctgcctctgcctcccaaagtgctgggattacaggcgtgagccaccgcgtccggcctctttttttcttttcttttttttgagacaaagtctcactgtgtcacccagactggaatgcagtgacacaatctcggctcactgaaacctctgccttccaggttcaagctattctcatgcctcagcctctcaagtagctgggactacagatgtgggccaccatgtctggctaattttttttttttttttttttttttgtagagacagggtttcgccatgttgacgagactggtctcgaactcctggcctcaagtgatctgccgcctcagcttctcaaagtactgggattatataggcatgagccactgagcctggccctgaagcgtttttctcaaaggccctcagtgagataaattagatttggcatctcctgtcctgggccagggatctctctacaagagcccctgcccctctgttggaggcacagttttagaataaggaggaggagggagaagagaaaatgtaaaggagggagatctttcccaggccgcaccatttctgtcactcacatggacccaagataaaagaatggccaaaccctcacaacccctgatgtttgaagagttccaagttgaagggaaacaaagaagtgtttgatggtgccagagaggggctgctctccagaaagctaaaatttaatttcttttttcctctgagttctgtacttcaaccagcctacaagctggcacttgctaacaaatcagaaatatgacaattaatgattaaagactgtgattgccaccaacgag

SEQ ID NO: 23059 - DNA, 3203 bp, Homo sapiens
tgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgcctt

SEQ ID NO: 23060 - DNA, 2201 bp, Homo sapiens
tgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgcctt

SEQ ID NO: 23061 - DNA, 3281 bp, Homo sapiens
tgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcggtgcacctggtataatctcagcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgcctt

SEQ ID NO: 23062 - DNA, 3260 bp, Homo sapiens
tgcgggcgtctccgccattttgtgagtctataactcggagccgttgggtcggttcctgctattccggcgcctccactccgtcccccgcgggtctgctctgtgtgccatggacggcattgtcccagatatagccgttggtacaaagcggggatctgacgagcttttctctacttgtgtcactaacggaccgtttatcatgagcagcaactcggcttctgcagcaaacggaaatgacagcaagaagttcaaaggtgacagccgaagtgcaggcgtcccctctagagtgatccacatccggaagctccccatcgacgtcacggagggggaagtcatctccctggggctgccctttgggaaggtcaccaacctcctgatgctgaaggggaaaaaccaggccttcatcgagatgaacacggaggaggctgccaacaccatggtgaactactacacctcggtgacccctgtgctgcgcggccagcccatctacatccagttctccaaccacaaggagctgaagaccgacagctctcccaaccaggcgcgggcccaggcggccctgcaggcggtgaactcggtccagtcggggaacctggccttggctgcctcggcggcggccgtggacgcagggatggcgatggccgggcagagccccgtgctcaggatcatcgtggagaacctcttctaccctgtgaccctggatgtgctgcaccagattttctccaagttcggcacagtgttgaagatcatcaccttcaccaagaacaaccagttccaggccctgctgcagtatgcggaccccgtgagcgcccagcacgccaagctgtcgctggacgggcagaacatctacaacgcctgctgcacgctgcgcatcgacttttccaagctcaccagcctcaacgtcaagtacaacaatgacaagagccgtgactacacacgcccagacctgccttccggggacagccagccctcgctggaccagaccatggccgcggccttcgcctctccgtatgcaggagctggtttccctcccacctttgccattcctcaagctgcaggcctttccgttccgaacgtccacggcgccctggcccccctggccatcccctcggcggcggcggcagctgcggcggcaggtcggatcgccatcccgggcctggcgggggcaggaaattctgtattgctggtcagcaacctcaacccagagagagtcacaccccaaagcctctttattcttttcggcgtctacggtgacgtgcagcgcgtgaagatcctgttcaataagaaggagaacgccctagtgcagatggcggacggcaaccaggcccagctggccatgagccacctgaacgggcacaagctgcacgggaagcccatccgcatcacgctctcgaagcaccagaacgtgcagctgccccgcgagggccaggaggaccagggcctgaccaaggactacggcaactcacccctgcaccgcttcaagaagccgggctccaagaacttccagaacatattcccgccctcggccacgctgcacctctccaacatcccgccctcagtctccgaggaggatctcaaggtcctgttttccagcaatgggggcgtcgtcaaaggattcaagttcttccagaaggaccgcaagatggcactgatccagatgggctccgtggaggaggcggtccaggccctcattgacctgcacaaccacgacctcggggagaaccaccacctgcgggtctccttctccaagtccaccatctaggggcacaggcccccacggccgggccccctggcgacaacttccatcattccagagaaaagccactttaaaaacagctgaagtgaccttagcagaccagagattttatttttttaaagagaaatcagtttacctgtttttaaaaaaattaaatctagttcaccttgctcaccctgcggtgacagggacagctcaggctcttggtgactgtggcagcgggagttcccggccctccacacccggggccagaccctcggggccatgccttggtggggcctgtgtcgggcgtggggcctgcaggtgggcgccccgaccacgacttggcttccttgtgccttaaaaaacctgccttcctgcagccacacacccacccggggtgtcctggggacccaaggggtgggggggtcacaccagagagaggcagggggcctggccggctcctgcaggatcatgcagctggggcgcggcggccgcggctgcgacaccccaaccccagccctctaatcaagtcacgtgattctcccttcaccccgcccccagggccttcccttctgcccccaggcgggctccccgctgctccagctgcggagctggtcgacataatctctgtattatatactttgcagttgcagacgtctgtgcctagcaatatttccagttgaccaaatattctaatcttttttcatttatatgcaaaagaaatagttttaagtaactttttatagcaagatgatacaatggtatgagtgtaatctaaacttccttgtggtattaccttgtatgctgttacttttattttattccttgtaattaagtcacaggcaggacccagtttccagagagcaggcggggccgcccagtgggtcaggcacagggagccccggtcctatcttagagcccctgagcttcagggaaggggcgggcgtgtcgccgcctctggcatcgcctccggttgccttacaccacgccttcacctgcagtcgcctagaaaacttgctctcaaacttcagggttttttcttccttcaaattttggaccaaagtctcatttctgtgttttgcctgcctctgatgctgggacccggaaggcgggcgctcctcctgtcttctctgtgctctttctaccgcccccgcgtcctgtcccgggggctctcctaggatcccctttccgtaaaagcgtgtaacaagggtgtaaatatttataattttttatacctgttgtgagacccgaggggcggcggcgcggttttttatggtgacacaaatgtatattttgctaacagcaattccaggctcagtattgtgaccgcggagccacaggggaccccacgcacattccgttgccttacccgatggcttgtgacgcggagagaaccgattaaaaccgtttgagaaactcctcccttgtctagccctgtgttcgctgtggacgctgtagaggcaggttggccagtctgtacctggacttcgaataaatcttctgtatcctcgctccgttccgcctt

SEQ ID NO: 23063 - DNA, 3069 bp, Homo sapiens
cagccgccattttctcgccgcttgtgtggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaa

SEQ ID NO: 23064 - DNA, 3057 bp, Homo sapiens
ggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagggcttcctgttgcagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaa

SEQ ID NO: 23065 - DNA, 3054 bp, Homo sapiens
ggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagggcttcctgttgcagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaa

SEQ ID NO: 23066 - DNA, 2935 bp, Homo sapiens
gggatgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagggcttcctgttgcagctgttccaggagctctgagtcctttggccattccaaatgctgctgcagcagctgctgcagctgctgctggccgagtgggtatgcctggagtctcagctggtggcaatacagtcctgttggttagcaatttaaatgaagaggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaac

SEQ ID NO: 23067 - DNA, 1965 bp, Homo sapiens
gtggctcggttcttgtgagcgaagctttgtccggttcggcaatggacggaatcgtcactgaggttgcagttggcgtgaagaatatctgatctggacttctgtggatttatggaagagctggctttatttctctatcctgtgggaggggcaaactttgattttgtatgtggagtaacttgaccttcagtttttttggtctgagaacaaaggccaaaaaatatgtaacagttaataacagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagggcttcctgttgcagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttat

SEQ ID NO: 23068 - DNA, 3027 bp, Homo sapiens
gcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttcagaaaagtggggaccagagtttgattttttttgtttttgtttttttggggtttcttttttttttccatgctgttatcattccttggttataaaatgaaatggcatatgtaaaggcagagttgttaactgctatatttcatctgttctatagggaagccattttgtctgtttaaaatttcagtttaattttgctttttttttttttttttttttcctttcaacttagttgacatacgtgccttaaaaaggaaaactagtgttgctattgtgcatttactagaaaaaaggaattggttgtttagggcacactgttatatgggaattaaaatatgtttaggcaggggtgtgtaaaaaggttaagtttttgtttctcctgcttggaacttattttgaattactggcttgtcacctttttttctatttaatcaaataagatacatgatattgaaagaataaagcagcatttttagtttttactaccttaggctttattgctttgaaaacaacattggccttttgtatctcacaattctggtctagattcagttatgaatgtaggcattagttaaaattaacaagatgcagagtattaatttcttaagacaacaaagtgatttctgtaagtttgagccctatgtggaaagcattgtggaatcttaaccttttcgtacacactcttgtgggacgtatcatataaatgtcagcactaagtaatgtcttgtttgtggctgaatatttttcgtagatgtttttgaagttgacatgacttacgtgcatttaaatatatattgccatccttagtttgtaattaagatttggaatatggttgtggatttctgagcatgtgcagactggtctagctagttcaggaactggtgcatgtatttttcaaagataaagaaagtgtactgcgaaaatatgcaggaagattaattttgtggcagttttctaaaactgacaaccaggtgggaccaaagtttatgtgcctttagtcttaatttaccttgcattgtaatattcagttttaataaatcttcaaaatattttgtatttaggaatagatctgactttaataaaaacatggctcagaatctacaggtcaaattaatttgaacagttcttgtcaatccgaattgttgattctgtttaaatgaccaatactttttgaaattgatgtacttagtttcaagattcatagattctgttatctatgtagacagaatggtcatgtatattttctattagttgagtttttacatctttagaaatgtaaaattcagtatagtttgaaagcggcacaattaaaaattaattttctaacaaa

SEQ ID NO: 23069 - DNA, 1700 bp, Homo sapiens
agtttctggaaaaacgactataaaaacccagaaccatgctgcatctttgcgaacctgagtcaagacggaatgctgagtgagaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatacattaaaccaacgtgctcaggcagttcttcaagctgtgacagctgtccagacagcaaatactcctcttagtggcaccacagttagcgagagtgcagtgactccagcccagagtccagtacttagaataattattgacaacatgtactaccctgtaacacttgatgttcttcaccaaatattttctaagtttggtgctgtattgaagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagaggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattgggggtgaatcacattgttcaatgtcatcacctatttgactgttca

SEQ ID NO: 23070 - DNA, 1488 bp, Homo sapiens
agccgccattttctcgccgcttgtgtggctcgctggctgcgtggctcggttcttgtgagcgaagctttgtccggttcggcaatggacggaatcgtcactgaggttgcagttggcgtgaagagaggatctgacgaactactctcaggcagtgttctcagtagtccgaactctaatatgagcagcatggtagttacagccaatggtaatgatagtaaaaaatttaaaggagaagataaaatggatggtgctccttctcgtgtacttcatattcgaaaattacctggggaagtaacagaaactgaagttattgctttaggcttaccttttggtaaggtgaccaacatccttatgctgaaaggaaaaaatcaggcatttttggaactagcaaccgaggaagcagctattactatggttaattactattctgctgtgacacctcatcttcgtaaccaaccaatatatatccagtactcgaatcacaaagaactaaagacagataatcacatttacaaaaaataaccagtttcaagctttgctccagtatggtgatccagtaaatgctcaacaagcaaaactagccctagatggtcagaatatttataatgcctgctgtaccctaaggattgatttttccaaacttgtgaatttgaatgtaaaatacaacaatgataaaagtagggattatactcgacctgatcttccatctggggatggacaacctgcattggacccagctattgctgcagcatttgccaaggagacatccctcttagctgttccaggagctctgagtcctttggccattccaaatgctgctgcagcagctgctgcagctgctgctggccgagtgggtatgcctggagtctcagctggtggcaatacagtcctgttggttagcaatttaaatgaagagatggttacgccccaaagtctgtttaccctcttcggtgtttatggagatgtgcagcgtgtgaagattttatacaataagaaagacagcgctctaatacagatggctgatggaaaccaatcacaacttgccatgaatcatcttaatggacagaaaatgtatggaaaaattattcgtgttactctgtctaaacatcagactgtacagctacctcgagagggacttgatgatcaagggctaacaaaagattttggtaattccccattgcatcgttttaagaaacctggatccaaaaattttcaaaacatttttcctccttctgccacccttcacctatctaatatccctccatcagtagcagaagaggatctacgaacactgttcgctaacactgggggcactgtgaaagcatttaagttttttcaaagagatcacaaaatggctcttcttcagatggcaacagtggaagaagctattcaggccttgattgatcttcataattataaccttggagaaaaccatcatctgagagtgtctttctccaagtcaacaatttaaaaatgggaagatgaagattg

SEQ ID NO: 23071 - DNA, 1259 bp, Homo sapiens
gctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcgaagacgctatccgatccatcaggcccagtattcctgtccgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaata

SEQ ID NO: 23072 - DNA, 1490 bp, Homo sapiens
ggctgcggcggctggagcaggcgagcggcggcggccgatagcgagtgtcagggccggccggggcggcgcttctcggcctgtcgctggtcggcctcctactgtacctcgtgcctgctgcggctgcgctggcctggctggccgtggggactaccgcggcctggtggggactgagccgcgagccccgaggttcgcgccccttgtcctccttcgttcagaaggcgcgacatcggcgaacactgttcgcttcgcctccggccaagtcgacagccaacggaaacctcctagagccgcggaccctgctcgaaggacctgaccctgccgaactgctcctcatgggcagttacctgggcaagcccgggccgccgcagcccgcccccgctccggagggccaggacctgcggaataggcctggccgccgcccgcccgcccggcgccgcgctccacaccgccctccccgccgacccatcgcgttcaccacttttacccctctctccccactcctcttctccgaccctccgggaggccttccccacgggatcgtgggactttaccagatcggtttgtaataacacctcgaagacgctatccgatccatcaggcccagtattcctgtccgggggtacttcccacagtgtgctggaatggttatcacaagaaggctgtgctgtcccctcgcaactccaggatggtgtgtagcccagtgactctgaggatcgcccctcctgacagaagattttcgcgttctgcgataccagagcagataatcagctcaacactgtcctcaccatcaagtaatgccccagacccatgtgcaaaggagactgtactgagtgccctcaaagagaagaagaagaaaaggacagtggaggaagaagaccaaatattccttgatggccaggaaaataaaagaagctgtcttgtcgacggtctcactgatgcctcttctgcattcaaagttcctcgacccgggccagatacactccagttcacagtggatgtcttccactttgctaatgactccagaaacatgatatacatcacctgccacctgaaggtcaccctagctgagcaggacccagatgaactcaacaaggcctgttccttcagcaagccttccaacagctggttcccagtggaaggcctggctgacatctgtcaatgctgtaacaaaggtgactgtggcactccaagccattccaggaggcagcctcgtgtcgtgagccagtggtccacgtctgcttccctgtaaccgcaggcatgtgacagaagaagcagatgtcaccgtggggccactgatcttcctggacaggaggggtgaccatgaagtagagcagtgggctttgccttctgacacctcagtggtgctgctgggcgtaggcctggctgtggtggtgtccctgactctgactgctgttatcctggttctcaccaggaggtgtcgcactgcctcccaccctgtgtctgcttccgaataaaagaagaaagcaata

SEQ ID NO: 23073 - DNA, 1679 bp, Homo sapiens
catcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggcttctagaattcctctccagagctactctcaagttatatccaggggacaggcccctttggctccaacccacacgcctgaactttaaggatcattggactatcttctctgtggccagcgcagctctcttctgtgttcacagaatggccactgataggcatgcctcttttcccacccactggaaggctcacaggcaaggtgagagaggacacagaaggtgccaacactgtcgctacagtaaggacctgaagtgactttgagaaattcaccctcacaaaccttccttcaggagcaggcattggtagtgcagaggcacagattccgtcctttaccagctgcagaatcttgggcaagttacatagcctctgtgagcctcatcggtaaacagtgggggttatgaaacccacctcacagggttgttgtgaggatccaatgagttgatttaggtaagcacctagcacatgccgtggcaccaagtaagcactcaataaatcactcaactcct

SEQ ID NO: 23074 - DNA, 1345 bp, Homo sapiens
catcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggagatagatgattttccctcttatttccaccagtttggcttttcagggaaggtggcagctggcagaatcccctgacaacaaaagcttctagaattcctctccagagctactctcaagttatatccaggggacaggcccctttggctccaacccacacgcctgaactttaa

SEQ ID NO: 23075 - DNA, 1250 bp, Homo sapiens
catcattccttcccaaagccaccggaagcattccttctaggaaaggtggagtcggtagtgagaagccggaggtgagaagacccctgagcggatggattcattcattttctgaatttcctatgtgaggacagtattagagcccagtgaggctttgagaggccccaaagatgagcgccaacagcagcagagtgggccagcttctcttgcagggttcagcgtgcattaggtggaagcaggatgtggaaggggctgtctaccacctagccaactgcctcttactcctgggcttcatggggggcagtggggtgtatggatgcttctatctttttggcttcctgagtgcaggttacctgtgctgcgtgctgtggggctggttcagtgcctgtggcctggacattgttctttggagcttcctgctggctgtggtctgcctgctccagctggcacacctggtataccgcctgcgtgaggacaccctccctgaggagtttgacctcctctacaagacgctgtgcctgcccttgcaggtgcccctacagacatacaaggagattgttcactgctgcgaggagcaggtcttaactctggccactgaacagacctatgctgtggagggtgagacacccatcaaccgcctgtccctgctgctctctggccgggttcgtgtgagccaggatgggcagtttctgcactacatctttccataccagttcatggactctcctgagtgggaatcactacagccttctgaggagggggtgttccaggtcactctgactgctgagacctcatgtagctacatttcctggccccggaaaagtctccatcttcttctgaccaaagagcgatacatctcctgcctcttctcggctctgctgggatatgacatctcagagaagctctacactctcaatgacaagctctttgctaagtttgggctgcgctttgacatccgccttcccagcctctaccatgtcctgggtcccactgctgcagatgctggaccagagtccgagaagggtgatgaggaagtctgtgagccagctgtgtcccctcctcaggccacacccacctctctccagcaaacacccccttgttctacccctccagctaccaccaactttcctgcacctcctacccgggccaggttgtccaggccagacagtggcatactggagatagatgattttccctcttatttccaccagtttggcttttcagggaaggtggcagctggcagaatcccctga

SEQ ID NO: 23076 - DNA, 1345 bp, Homo sapiens
aagctccgggcagggctgggaaggaaaggaaataccaaaatatttgcagactggatccaaatcaggagcccagatgaacttaaagaagcgagcatgggattcttagtttttcaagatccgtacacacgaagcctttaatcagcatcaactccagtgtccgttttctctggttttgtgaagactgcacaaaactctcatgatggagaaccaaaggacttagttacctgtttcagtgtcatctaaagtcaactgaaaagtgaagcaggcagtaatacagccatggaaagaaattcaagtttatggaagaacctaatagatgaacacccagtctgcacaacctggaagcaagaggccgaaggagccatttatcatcttgccagtattttatttgtagtaggtttcatgggtggcagtggattcttcgggctcctttatgtcttcagtttgctggggttgggttttctctgttctgctgtctgggcttgggtagatgtctgtgcagctgacatattttcctggaattttgtactgtttgtcatctgcttcatgcaatttgttcatattgcatatcaagttcgcagcataacctttgcccgagaattccaagtgttgtacagctcccttttccagcccctggggatctctttgcctgtcttcagaacgattgctttgagctctgaagtggttactttggaaaaggaacactgttatgccatgcaggggaaaacttccattgataaactctccttgcttgtttcaggaaggatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaagatatcactatgatattcggctacccaacttctatcaaatgtcaactccagaaatacgcagatcacccctgacacaacattttcagaattccagacgatactgtgataaatgacatcaaagtctgaaatttataagtataaaaaaagactctctcttcatcattccccagtgaaatagcaaaatacaaaaaaagagctccctaatgtttttataaatcaaattcagaagcgagatgccattgccaactgttttattcctttcaacaactgcattgtgaataaactttacaaatttttcttgta

SEQ ID NO: 23077 - DNA, 582 bp, Homo sapiens
gttttattgaagtataatatgcacacataaatggacatatataaatgtacaacttgatgaattttctgatgaatttcactcaatattccagaatcctgactgtataaggaacatgataacatgaatcttacaggacattatgtcacttattataatgtatgaatttaatattttgcctttcaaaatcataaagggcaagagtcatcagggatctgaaatacacttcctctaccccccacccctccccaattatgtgctctctttctccttcccttataaatgttgttcttgtgttttgataggatcagagtgacagttgatggcgaatttctgcattacattttcccccttcagttcctggattctcctgagtgggattcactgagacccacagaggaaggcatttttcaggtaaccctcactgcagaaactgattgtcgatatgtgtcttggaggagaaagaaattatatctgctctttgctcagcatcgctacatctcccgccttttttcagtgctaattggcagtgacattgcagataaactctatgccttgaatgacagggtatatataggaaaaaga

SEQ ID NO: 23078 - DNA, 1755 bp, Homo sapiens
tgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaat

SEQ ID NO: 23079 - DNA, 1743 bp, Homo sapiens
atctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 23080 - DNA, 1848 bp, Homo sapiens
gctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattcaataggct

SEQ ID NO: 23081 - DNA, 1877 bp, Homo sapiens
atttaaagggcccgctcgccgcgccgctctgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattc

SEQ ID NO: 23082 - DNA, 1672 bp, Homo sapiens
ggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctgggg

SEQ ID NO: 23083 - DNA, 1975 bp, Homo sapiens
gagccgctgctggtcccggccttgcggcctgcgggggaggctgcccggaggaggcagcggcggcggcagcgcgtcctcggtccccaggaccacggcttctttcctgccaggtcacaggctgtgcgtgtgcatgccgaacacccacatgcacacagttggtggctcagtctgatgtacctgacttctcacgccttcccccagtcctccagtaccgtgcctctacatgggctgggcagccccaaactgaaatgtgagtgccagagtgcatcctttaagcgaggtctgccccacggacacccgctccctctgtgtccctgctttgacagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaagtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctgaggcacatctgtggaccctcataaccctcttaagacccctctcagggtgccactgatgggggatgagggaaggccctctctctactccttgaccccctccatccttgacccccaacacctcaacacacacacacacacacacacacaaaatcacaccattttcatgcctgtcaatccccaccccaccacaaggcaggaagggggtggtgcctgctggggcctagagggggatgcttggggaaacagagaaggggagatccagggcctccccgccttccttcttcctttttatatacaatttgttattgtcaaataaaagtaggaaatattc

SEQ ID NO: 23084 - DNA, 558 bp, Homo sapiens
gaggctgcccggaggaggcagcggcggcggcagcgcgtcctcggtccccaggaccacggcttctttcctgccagagcgactctaccttggaaaccagggattccccttcccgtcgcccgccccatttgatatatgggcctgaaatgtatgccatcccatcaccatcggactggactgttcacagcactggagagacagaggtccttcattcactccaggtcacaggctatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtctt

SEQ ID NO: 23085 - DNA, 1539 bp, Homo sapiens
ctctgggagccgctgctggtcccggccttgcggcctgcgggggaggctgcccggaggaggcagcggcggcggcagcgcgtcctcggtccccaggaccacggcttctttcctgccagatctatccatctggccatccatccgtgggggtctgcaatggccacctttagccgccaggaatttttccagcagctactgcaaggctgtctcctgcctactgcccagcagggccttgaccagatctggctgctccttgccatctgcctcgcctgccgcctcctctggaggctcgggttgccatcctacctgaagcatgcaagcaccgtggcaggcgggttcttcagcctctaccacttcttccagctgcacatggtttgggtcgtgctgctcagcctcctgtgctacctcgtgctgttcctctgccgacattcctcccatcgaggcgtcttcctatccgtcaccatcctcatctacctactcatgggtgagatgcacatggtagacaccgtgacatggcacaagatgcgaggggcacagatgattgtggccatgaaggcagtgtctctgggcttcgacctggaccggggcgaggtgggtacggtgccctcgccagtggagttcatgggctacctctacttcgtgggcaccatcgtcttcgggccctggatatccttccacagctacctacaagctgtccaaggccgcccactgagctgccggtggctgcagaaggtggcccggagcctggcactggccctgctgtgccttgtgctgtccacttgcgtgggcccctacctcttcccgtacttcatccccctcaacggtgaccgcctccttcgcaacaagaaacgcaaagccaggggcaccatggtaaggtggctgcgagcctacgagagtgctgtctccttccacttcagcaactattttgtgggctttctttccgaggccacggccacgttggcgggggctggctttaccgaggagaaggatcacctggaatgggacctgacggtgtccaagccactgaatgtggagctgcctcggtcaatggtggaagttgtcacaagctggaacctgcccatgtcttattggctaaataactatgttttcaagaatgctctccgcctggggaccttctcggctgtgctggtcacctatgcagccagcgccctcctacatggcttcagtttccacctggctgcggtcctgctgtccctggcttttatcacttacgtggagcatgtcctccggaagcgcctggctcggatcctcagtgcctgtgtcttgtcaaagcggtgcccgccagactgttcgcaccagcatcgcttgggcctgggggtgcgagccttaaacttgctctttggagctctggccatcttccacctggcctacctgggctccctgtttgatgtcgatgtggatgacaccacagaggagcagggctacggcatggcatacactgtccacaagtggtcagagctcagctgggccagtcactgggtcacttttggatgctggatcttctaccgtctcataggctga

SEQ ID NO: 23086 - DNA, 8536 bp, Homo sapiens
cggctccgggggtggcggtcggacagtgtctagcacgctcagtccgggcttggggccccgcggcggagaaggaggtagagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaagttcgttctattggctccattgcacttagaaaagcagaggacattgacttcaagtaccactttgacttctttagtgtgaacttcaatgaagaactggtggctttgtatggtggaagtcttcagaagcagaccaagtttgtacatgaatgtattaaaacaattctcaaactctataagggtcaagaatttgctccaaaaagtgtggcaataattggtcattctatgggtggccttgttgcaagagcattgcttacactgaaaaattttaagcatgatctgataaatcttcttattacacaagccacacctcatgttgctcctgtgatgccattagatcgtttcattacagatttttatacgactgtaaacaactattggattctaaatgctcgacacataaatttaaccacactttctgtagctggaggattccgggattaccaagttcgttcaggattgacttttctaccaaaattaagccatcataccagtgccttatctgttgtgagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacagggacatctatgtgggttctagtaaaagtgtccaaatggacctatgtagcttacaacgaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcatggaaagctgaactgctgccaacaattaagtatctgacattaagacttcaagactatccatctttgtctcatcttgttgtttatgtaccatctgttcgtggaagtaagtttgttgtagattgtgaattctttaaaaaagagaaaagatacatacagcttcctgtaactcatcttttttcctttggattgtcttcaaggaaagtggtgttaaatacaaatggcctatactacaatctagagcttctgaactttggacagatataccaagcttttaaaatcaacgtggtaagcaagtgctcagcagtcaaagaagaaataaccagtatctatagacttcatattccttggtcttatgaagattcactaaccattgcacaggctccatcttccacagaaatttctctgaaactccatattgctcaaccagaaaacaatacccatgtggcattatttaaaatgtacacgtcatcagactgtcggtacgaggtgacagttaagacttccttttcacaaatacttggacaggtagttagatttcatggtggagctcttcctgcttatgtcgtatctaatatccttcttgcttatagaggacagttatattctcttttctcaacaggttgttgcttagaatatgctaccatgttggataaagaagccaaaccatacaaagttgatccttttgtaattatcattaagtttctgttggggtataaatggtttaaagaattgtgggatgtattattgttaccagaattagatgccgtcattttaacttgtcagagtatgtgtttccccctgatatccttgattctctttctgtttggaacgtgtactgcctactggagtggcctactgtcttctgcatctgtgagacttctttcttcattgtggctagctttgaaaagaccctctgaacttcctaaagatatcaagatgatatcaccagacttgccctttttgacaattgtcttgatcatagttagttggacaacttgtggagcactagccatacttctttcttatctttactatgtgtttaaggttgttcatctgcaagccagcttaacaacttttaagaatagccagcctgtgaatcccaaacactctagaagaagtgaaaagaaatccaatcatcataaagactcctcaatacaccatcttcgtttatctgccaacgatgctgaagatagccttcgcatgcacagtactgtgattaacttactaacatggattgtattactcagcatgccttctctaatttattggctaaagaatcttaggtattattttaaacttaatcctgatccatgtaaacctttggcatttatccttattccgactatggcaattcttggaaatacttacactgtttcaataaaatcaagtaaattgttgaagactacttcacaatttccacttcctctggctgttggtgtgattgcttttgggtcagcacatttatataggcttccatgctttgtcttcattcctcttttactccatgcattatgcaactttatgtaagattggacttaaggaatgatgaagataatttatgtgtttagggccagtgataagagggaacacacagatccatcagtatggacagcaagatcctttggagaagacaagtctatttttacaatattgaaaataggaaattagttttgtaatgtttgagggaagtagttgaagcatggttttgttttgtggtgtggaatccatgtagtaatcatttttgaaaaattcatgaagggatatatggtgatcactatcattgaggactcctgtgcatataaaatagtctgttttatcaactgtacgagaagtctgatatgagagatttagtagatgcagcattatttgcagtctcactgcaagcattctgctcatttcatcaaactttttttcacaaaagtaggttattttgaatttgctatagtttacctattaagaaataagtctttaaataactgatgaaatttatagctgtttggtttctcaaaggttaaatagccacagaaagcctttggttagtttttggcagccaccatgaacaaagtggatcttgtcttcttacatctatgaaaatagagctttgaatggtaaggagatatgttttcttggtaaccaatgcaagattgatgggtggaaacatgattcaaacttacacaatttttcttgctatttttcaaatatgaatcttactatatattctcggtgaacatcaggagactattaaagaggtctgctgttaaatgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactactgattgtaatttggaactgataataggtagagattgctaacactgttttttttcctggatcttttttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagtttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaactta

SEQ ID NO: 23087 - DNA, 1246 bp, Homo sapiens
tttttcctaacattctagtgttttgaagctgctacaagtgattgatttcgagctttttttaaaaactcctcctttgtacaaaacagaaccgaaattcttcaaaacgaattaagtcatttgcgagtttgaatggaagctggacgaaattgcctcctccagttaacgtggaacccattccccaagagatggaggttctggagagcaagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaagttcgttctattggctccattgcacttagaaaagcagaggacattgacttcaagtaccactttgacttctttagtgtgaacttcaatgaagaactggtggctttgtatggtggaagtcttcagaagcagaccaagtttgtacatgaatgtattaaaacaattctcaaactctataagggtcaagaatttgctccaaaaagtgtggcaataattggtcattctatgggtggccttgttgcaagagcattgcttacactgaaaaattttaagcatgatctgataaatcttcttattacacaagccacacctcatgttgctcctgtgatgccattagatcgtttcattacagatttttatacgactgtaaacaactattggattctaaatgctcgacacataaatttaaccacactttctgtagctggaggattccgggattaccaagttcgttcaggattgacttttctaccaaaattaagccatcataccagtgccttatctgttgtgagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacaggaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcat

SEQ ID NO: 23088 - DNA, 2443 bp, Homo sapiens
ggctccgggggtggcggtcggacagtgtctagcacgctcagtccgggcttggggccccgcggcggagaaggaggtagagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagaaaatagaacttccaaagaaactggcaaaacgctatcccgcatatgagttgtatctttatggagagggatcctatgctgaagaacacaaaattctccctttgacgggtattccagttctctttcttcctggtaatgctggaagttataagcaagttcgttctattggctccattgcacttagaaaagcagaggacattgacttcaagtaccactttgacttctttagtgtgaacttcaatgaagaactggtggctttgtatggtggaagtcttcagaagcagaccaagtttgtacatgaatgtattaaaacaattctcaaactctataagggtcaagaatttgctccaaaaagtgtggcaataattggtcattctatgggtggccttgttgcaagagcattgcttacactgaaaaattttaagcatgatctgataaatcttcttattacacaagccacacctcatgttgctcctgtgatgccattagatcgtttcattacagatttttatacgactgtaaacaactattggattctaaatgctcgacacataaatttaaccacactttctgtagctggaggattccgggattaccaagttcgttcaggattgacttttctaccaaaattaagccatcataccagtgccttatctgttgtgagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacagggacatctatgtgggttctagtaaaagtgtccaaatggacctatgtagcttacaacgaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcatggaaagctgaactgctgccaacaattaagtatctgacattaagacttcaagactatccatctttgtctcatcttgttgtttatgtaccatctgttcgtggaagtaagtttgttgtagattgtgaattctttaaaaaagagaaaagatacatacagcttcctgtaactcatcttttttcctttggattgtcttcaaggaaagtggtgttaaatacaaatggcctatactacaatctagagcttctgaactttggacagatataccaagcttttaaaatcaacgtggtaagcaagtgctcagcagtcaaagaagaaataaccagtatctatagacttcatattccttggtcttatgaagattcactaaccattgcacaggctccatcttccacagaaatttctctgaaactccatattgctcaaccagaaaacaatacccatgtggcattatttaaaatgtacacgtcatcagactgtcggtacgaggtgacagttaagacttccttttcacaaatacttggacaggttgttgcttagaatatgctaccatgttggataaagaagccaaaccatacaaagttgatccttttgtaattatcattaagtttctgttggggtaagttttattatctgtgataatgattttaattgtgttttacatgtaacattatatttggttccataatgcaatataaattttcatacagatttggcagttgacttgtttcattaaatgaggttttttttttctcttaggcaaaggtctaataagtatatcaatgtctacttcaatagtatcatttcaaaagtaattattcactttatgtatatcagtctaaacttagactgcctttaatgtttgtaaataggtgtatatggtccatgatctgtgagtatcctagattcaaacgcaaatcattacagggtattgatgaaacagtgcctctctgatcacttttaaaagtatattttagacctctctaccctagttaacattccattcttaatttagtcacattttcagatttttggttaagcatcaatatgtagatctttttttccatcattacaactaacttggctttct

SEQ ID NO: 23089 - DNA, 10453 bp, Homo sapiens
ggctccgggggtggcggtcggacagtgtctagcacgctcagtccgggcttggggccccgcggcggagaaggaggtagagggggcggcggcggcggcggcggtggtggcggcaccatgtttcttcactcagttaatctctggaacctggcgttttatgtcttcatggtctttctggcaaccctggggctgtgggatgtcttcttcggcttcgaggagaataagtgcagtatgagctacatgtttgagtacccggagtatcagagttcagcagtgcctaagacctgggtctcaacagaccacctctccattgtgtggtgtaaacaattgcagttgactacagttcgagcattctttgatcttattgatgctgatactaaacaaataactcaaaattccaagaagaaactgtcagttttgtatcaccactttataagacacccatcaaaacattttgaggaaaatccagctataatttctgacttaacagggacatctatgtgggttctagtaaaagtgtccaaatggacctatgtagcttacaacgaatctgagaagatatattttacatttcctcttgaaaatcatagaaaaatctacactcatgtctattgtcagagcactatgctggatacaaatagttggatttttgcttgcataaacagcacttctatgtgcctgcaaggggttgatttatcatggaaagctgaactgctgccaacaattaagtatctgacattaagacttcaagactatccatctttgtctcatcttgttgtttatgtaccatctgttcgtggaagtaagtttgttgtagattgtgaattctttaaaaaagagaaaagatacatacagcttcctgtaactcatcttttttcctttggattgtcttcaaggaaagtggtgttaaatacaaatggcctatactacaatctagagcttctgaactttggacagatataccaagcttttaaaatcaacgtggtaagcaagtgctcagcagtcaaagaagaaataaccagtatctatagacttcatattccttggtcttatgaagattcactaaccattgcacaggctccatcttccacagaaatttctctgaaactccatattgctcaaccagaaaacaatacccatgtggcattatttaaaatgtacacgtcatcagactgtcggtacgaggtgacagttaagacttccttttcacaaatacttggacaggtagttagatttcatggtggagctcttcctgcttatgtcgtatctaatatccttcttgcttatagaggacagttatattctcttttctcaacaggttgttgcttagaatatgctaccatgttggataaagaagccaaaccatacaaagttgatccttttgtaattatcattaagtttctgttggggtataaatggtttaaagaattgtgggatgtattattgttaccagaattagatgccgtcattttaacttgtcagagtatgtgtttccccctgatatccttgattctctttctgtttggaacgtgtactgcctactggagtggcctactgtcttctgcatctgtgagacttctttcttcattgtggctagctttgaaaagaccctctgaacttcctaaagatatcaagatgatatcaccagacttgccctttttgacaattgtcttgatcatagttagttggacaacttgtggagcactagccatacttctttcttatctttactatgtgtttaaggttgttcatctgcaagccagcttaacaacttttaagaatagccagcctgtgaatcccaaacactctagaagaagtgaaaagaaatccaatcatcataaagactcctcaatacaccatcttcgtttatctgccaacgatgctgaagatagccttcgcatgcacagtactgtgattaacttactaacatggattgtattactcagcatgccttctctaatttattggctaaagaatcttaggtattattttaaacttaatcctgatccatgtaaacctttggcatttatccttattccgactatggcaattcttggaaatacttacactgtttcaataaaatcaagtaaattgttgaagactacttcacaatttccacttcctctggctgttggtgtgattgcttttgggtcagcacatttatataggcttccatgctttgtcttcattcctcttttactccatgcattatgcaactttatgtaagattggacttaaggaatgatgaagataatttatgtgtttagggccagtgataagagggaacacacagatccatcagtatggacagcaagatcctttggagaagacaagtctatttttacaatattgaaaataggaaattagttttgtaatgtttgagggaagtagttgaagcatggttttgttttgtggtgtggaatccatgtagtaatcatttttgaaaaattcatgaagggatatatggtgatcactatcattgaggactcctgtgcatataaaatagtctgttttatcaactgtacgagaagtctgatatgagagatttagtagatgcagcattatttgcagtctcactgcaagcattctgctcatttcatcaaactttttttcacaaaagtaggttattttgaatttgctatagtttacctattaagaaataagtctttaaataactgatgaaatttatagctgtttggtttctcaaaggttaaatagccacagaaagcctttggttagtttttggcagccaccatgaacaaagtggatcttgtcttcttacatctatgaaaatagagctttgaatggtaaggagatatgttttcttggtaaccaatgcaagattgatgggtggaaacatgattcaaacttacacaatttttcttgctatttttcaaatatgaatcttactatatattctcggtgaacatcaggagactattaaagaggtctgctgttaaatgtaaagaaaaaatgctcgtagctatttgcttcctggtattggagcagttcagttgtttagtttataccattggattcaattcattgcaccatggttgccaaaagtgcctgaggtcataatggattgttaaaataactaaattccagtggttggaaactctaggtttgtaccattttttctgctgtgggaaaaaacaacaacaacaacatgatcaaggtaacatcacatttgatgtataatattatactattaatggaatatcagtagacaactgttaacccattagtagcatgagtataaacagtacacctgaataaattggagacattagccactaggtttaacagtggaatcttgatttgcctaggtgacttctgggattactgtttgacaaataagagtaacattttatttcatttcagaatttacgtcacttttagctacaagagtaggaagaaggtaatcggcaaggcagaagagtatactctttgccttaggatagcgtaaactcaggctgagacatacccggcttatagagttcttctagatgtgtagactgtaaatgcccaaatcctctcaactaaagttttagtgattccacaaagcctctcatgtaaatttccagtgattccaccattgcacttgtgaatatgtatccttgttagtacccagggatgtcctcgagcaccagttttattttatctgccattgcatctggattccattacagcctctcagctgttactgcctgtggacagttacttctgcttactgcctgtagagagttacctaacttctcttctcagttcttcctcaggtcctggctattttggcctcagttgaagggagtcttgctctcatctctgagggttttaagtttgtttgatcccattgttgtcttttctagctttgagcatgtttttcagtattcatattttaacttactgagaacattaaagggaaatgataaactcgtggtggggatatggcagacaggtgcttgtttgtttgagagaagtagcagaagagataaaatacaaagtgctatatgtttcagctggagaggaaagagagagaatttattagattatatacttgtcccatggcataccacgtatatgtttaaatagggacacatctccctatgtttaactatacttataaacaactttgatacacattgcgtcttttattctgtcacctgatattttagtgtatctcaagttacagattacatgtgtccttaaactatttctgaatttggacttagttccatatacagaaagaactttagaaaattcattaatttggatcttctattgatagccataaatattatgtttatgtattctaaaacctctttgtttagttagtactgttcatgaatgtaacaagcttcaatttctcatttgtgagtagtacatttgctttttgtttgtttgtttgtttgtttttgagatggagtctcacgctgtcaccaggctggagtgcagtggcgcgatttcagctcactgcaacctccacctcccaggtgcaagtgatgcccctgcctcagcctcccgagtagctgggactacagacacccgccaccacacctggctaatttttgtatttttagtagagacggggtttcaccatgttggctaggctggtctcaaactcttgacctcgtgatttgcccgcctctgcctccccaaagtgctgggattacaggcgtgagccaccacgcccagccgtacatttactttttaaagcagcagactaggtacactaattctcactcaaatattttcatgggaatgtagttatcaccaagtcctaaagtattatttatgccaaaaaaaatttcattttaaggactacaaaaatgattctaattaaacattttataatcaatagtaggttgggtctttagccattatatgtgtatatatacagacacatatgtatacacttacattttgacagggtcttcattgagtcttgatgcactttaaacccagctggctaccagagatgcgaaggtgggctctttgaagattagcaaaatggacgtttctgtcacttgagaaaaggaaagttctttgcctttaaattacacagttttcatcatgcccacaatctatattattggctggttaaacagcactgccctattagcaatgttaacaaaaatgaaattatttattggcggttatagattatctaattcaggaaatttctgagctcaacttttacagcaactgttatgccttctaatttagcaattgagttatgagtaagttttgtgcttaactcctagaccctattgttgataaccagatcaaatatagtctgtacagaggaaaacactgggaacatttagtatttctaaagcctcctttggagttactactgattgtaatttggaactgataataggtagagattgctaacactgttttttttcctggatcttttttatgccagaaattaaacaggttctgctaactcttttttttctcttggttatcaccagaatgaaaatatttaaagtgatgactctagaaaagccatctgtgcctggttaacattgagtttgagtctcttcaatatatattgatcatgtattgattaatctttattttttcatattttggctagacaaattcagatctatataatggaataccccttcttgagtgaactatactactaatctacatgattatatagtaaggaaaaaagaagaaataactgtaataggcatagtgtttgttgttggttgtcttgtcattcatgtgatactactcatttccaaaattcacacaaacttacatgaggtggattatttgttttgttcattatttagttcctatatgttttttctttagaaacagagtctcattctgtcacccaggctggagtccaatggggcggtcatagttcactgcagccttgaactctttggctcatgtgatcctcccatctcagcctcccacagcaggtgagactacaggtacatgccactgtgcctgactttttaatttttttgtagagacgaggtttcagtttgttgcccaagctgatcttgaactcctggtttcaagcgatcctcccacctcggcctcccaaagtagtgggatttcaggcatgaccacctggcctagttcctatacttttcttaattcttcagacttctcacatttagtatagtgcattcatttcatcttgctgtttattagcaccctttgtggccaagggaaataaaaggtggtaaaattcagttttcagtttagttcttgaaagctctgggaaatggaggaaacacaaaactatgaattaaactagggctgttgatttctgaacccccagataaatcagttgacccacattttcattttaggtgttaggtccaaattagcataatgtcttgcattattattaggttcagtgtgaaactttacagtgctgcatttgaagtttagtaactggttattattaatcatttgggaaaaatgaaaatgtgttgggactttctatgactaggcatttgttgattatttttcatgattgctttttgttttctcattgtgtaggatttgtgaacttgtatattacaggaaacaagatactttgtaaaatttactggggaaaatccatttggagtgcatgacatttgccaggataagaaagcagtaatatgtttgtattataaaattacaccctgccagaaaactttctttcctagtaaggtaaatgtagaagggacttttacagcatagtaagttgattaggagccaaaattttattccagtttttttttgaactaagaatgttttaaattctgtaatgaacttttatgtttacccattactcatgcattctttcacaatatgtttaatagcctgaggaaataggaaagctgtgaagctactaccattctttacttttaataagaataataggaaagaaaagtcaggtcagtaatccaaatccaaatatgtatactgcaaatgctcaagaagtcacattttttgataaattgtattgagtacagaagaacttatatgaatttattatctgttaataacttagttttgacaacagaataacatttggaaattgtgagaataatcaagctgtttttccattaacagtgtaaattcataacatgtccttcaaaaggtgatattctaagctgtcttaattgtctacggttgataacttttaaataaagtacaggactttctgaaagtgtttggcatgttatgctgccaaaaacaatctgtgttttgaaataccaattaatcagttaatttctgaagactttgtataggacttgatatatgagtcagaatctgtctgtactcattctgtacattgtaactttgaacacttatgaaaaactgtatctgttggtgtgttttgattagttagtgtagatttgtttgcgtatttgaattccgattttagtttaggaagactaaaagtagccatttttgtaaagttcatatgctattttttaatgtcatttttgtttttaatatttatacaatagtgatgttactagtaaaaaatgtttatagataacacgtagagctattaactgttcaaaagcctacatgataggcatattttgtatttcgtgttgcactcgttctgtttcatattggactttttacatcccttttttagcaaaaaaaagagacacatttgaattctctttagcataaagctgtgcattggaaactatgtgactgtatccatacggttagcaaaatactctttgccaccaaaggtaaatgaaactgtaaaatacctctggatatttgtgccaatgaacttttcttagcatattaggattaaagcaaaaataatcttttcagtatgtttcatctaggacttacaataaatgtttaaaccatgaaaacttatatttcataccctaatttttctttgaaaatattcaagatttgtagcctagtgtgttctattttgtgtgattgcttgaatgttttctgattttattgggtaaaagtttgcctagtaatgatctttcagcaattcattgaaataattatttgaagtaatcttgcttcagatttaatttgtgatgtacattgttgtacaagccattttagtacaggtgtctcatttatgtagttgaaaggtgactgtggaatttcttttgttttttatgtatttccattcagtctctttatatagtcacatgtttcacaggggaacttgtccactggaacctaacatagtacaaccttttaatatgcgtatcttaaaggaaaatattataaaacaagatattaatactaaagtgttaacattaatatgttgttctcatggaagaaaagtagaaaatgtgataggcttagaaattattttttatcagcattaagtgcttcaatttctccccataaagattctaaggaaatttcagttcctcatattatagttttccccataatttaatattactaagtatttctctgcccagtaatgttgatgcagtttgcataaatagccttggaagtaaggaggcaggacagaaagccaaatatcgaaatctctggccttgatttagtgacagtttattctaatggggaccataggtgttattagtaaaaagatagtgtacaaggcctaagttcagtttacattgttctttgaaatgagttcatcttttgtgttgaataattgtattctaagtaggagatgcctgtatttaacataatcatgctttctatataatcaaatatgtatttgttggaatactggtagaaataaccttcccttcctccactgtgcagtggaaaaaaaactcccgatttatactgtatataaattaggaaattatgttacatatttacatttttaaaaatataaaaatgacatattattttgaagtgattgtattatagtttctgaagcttatgactggctataaatataacaacatacccatgagaaaccagaccaaaattgaatatatatcatcactgtgaccttgaacttatagtcatttgggataaaacagagtgtgccttgaaatgataaagagtgccctgcaattttataactgtacattttattatgggtggtcctctcaaattggccccaaatccttgtcttcgaggttggtgaaataaaagtttaaaataaaagttgactggtatttcctttagtatttccagaactattgctgtagaggcctcccttaattttcagagttctcattttgaattaaagtagacttacgctacatagatgtagaaaattaggtttggcttaggtttctgaaaaaatattctaggagaaggtggtagcattgttctgaacttaccacacttggaaaaactaatcttcaaatgtaattttttgtcttattaatgagtaatctgtcaaagacatgaattctttgacttgtgctcattctttctgaacttattgaggcttatatatatcaaataaggttaatttacacaataattatttttaataattaataaactcattcatgtagtatattttaaaacattatttcctctcatttttccttctcttttttcttcctatatatttttaaggcttcaagagaaaacgggcttcagtttttaaaaaaatgtagacttgcatttttactgtgcttatttaaaataatggatataatttatattaaggtccaaattattttattcacaggataatcatggtctctgataaaagatgcccacatttctgtgtactcacagttgttgtatatttttcaatttcaattttgaaagtaaactcaacacattgttttcccattttacctccactacctactcgccagacaaaaatatagatttctctaaaaacacatacaaagaaaatgtctttccttaaaacatgatcttattgacatgaaggtagtttgagcaagggtatgtaataaaataaatggctctcaacctgcatcaatttttatactatagttaaaaaatttatagaggacaacctatgtgttatgctgagatagactcagtaatcatttgtttgcaaattgattatttttttctcatccatccagaaagtacagtgcataacaacaacacttaacaagtgcagaggaacctgtcctgtagtatataataaaaaatgattgtcaccttgctgatctttccatttaaacatgcatgatctccagtactttgtacaatgtatagtatattaaatacatttatgtgtaattttgtgtgtatttttatatggtataattaaaattattacatttatgtgattgtaattcacaaaaagtactacttactatattctgtagagtgtgttgtgaatgtttttacctgtgtttgagcattatggtgtaggtttaatagatgaatatttgccttcagtctctgctcaggtattaatgtgtagtaatttttggtgctttctttttaatctgtgataatctggtgttctgaatgttcaaaaataaatttggttgaatacgca

SEQ ID NO: 23090 - DNA, 1718 bp, Homo sapiens
tacagctcccgtcactagctttttctcctcaagcctgcactgcacaccaactgggacggagggtgcagatgaataaaggcaaatccatcaccaaaagacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggccttccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttgaaa

SEQ ID NO: 23091 - DNA, 2164 bp, Homo sapiens
ctggaccggcgcggacttgccccagacctacggggagcgccccaggtctttaatgacagcttaaatgtggctgttggaaaagtcgaaagggatgtggctgacgtggggcgtgtttcgctcctttgcaagagtcggaaagggagttgggagccgcgcggctggccccaggcccccgcgcctcgccgccagcaagtaggtgggggagccgccgccgccgccagccccatcccgctcccaagcctcgcccgctgcgccctggccgcgggcgccgagagggtgcggggcctcgccgtgcctcctccaccctgctcattaacctgcctgctccgctccgctccgggcggccccagacacgggtttcccgcggcagcacccgcggcccgcccggcgcagccgccgccccgaccccccggctccggggggcaatgagggggcagtggaaggggcactgctcctcgggcattacttagagaaacgagaccgtcccgccctctcgccggccctccctctctcccgcccgggcccgcgcaattctccgccagagggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggccttccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttg

SEQ ID NO: 23092 - DNA, 3428 bp, Homo sapiens
atggcgagaatgcctggcagcggggactgtaacaccagcgcgggcggcagcgccagcgctgccgccgccgccgccgagaacaatggggagcggggcgagggcgagcgcggcgcggggggccgcggccgccgccacagccgtccgcactactgcagcgcgggcgaggaggaggaggaagaggaggaggaggacgagatccaggaggtgcagataacgggggacgaggaggaggaggaggacggaggtggggggctggaggaggacgaggaggaggaggaagaggaggagatggggctggactgggacgagcccctggagcccgaggactcggccggggaggagctggagcccgagccggtccatatgatcaatatggaccagagcgccgcgctggagcccgaggcgccgccgcgactgctggcgccccgggcccgcggtgggccgcccggggacggctccgagctggaccccgacgtgctgcagcgccccgagcgggcccggctgagcgagaacacccggctggccacccgctacgccgtgcgcatcttccgggagtacctgagcgagaaggcgcagagcccggacttcgagaccatggacaagggggcgctgtgccgcgtgctgcgctccttctatgccgaggcccgctccaaaagcggccagctctacagcaagtcgtcgctcatcagcatccgcagctccctcaaccgctacctcaatgagcccccgtactgccgcacgctcgacctcaccaaggaccccgagctgcgcagcgccaacctgacgctggccgcggtcatccgcaagctcgaggagcagggcgccgggccggtggtgcagaagcaagccatcacgcgcgccgacctgcgcaagctgtacacctccagcgtcttcagcaccaacacgcccttcgggctgctcaacaaggtctggttcgagacgtgcatgtacttctgtacccgcggccgcgagaaccagcgtgagttggaggaggactcttttgggctggccatggacgaggacggtcgcaagttcgtctacttcaagtccctcgggccctaccacaagtcgcgctcgtcgtcgtggagcaagaagcgcgccgagagcagcgacgaggagaacttgccccgcatgtatgagacgggcaccgagttctgcccctacgccagcttcgtcaagtacctgtcgaaacgcaaccctctctgcaaggcgttcttccagcggccccgggaccactgcagcgagggcgatgtgacctggtacgagaacaaagccatcggcaagaacttgctaggcactcggatgcagatgctctccaaggcggccaagctctccaagacctacaccaaccactgcatcggcgccgtctccatcgccacgctcaacagcatcgcgggcattggcaccaagctgggctcgcccgccccgcagggctgctacgccgaggctctgaacggggcggcacggcaccactcccaccacccccccacccatccctcccaccaccaccgcccccagccgccctcgctggggaacacttacatcctccccaaagacagccaggtcgggcccgacgtgaaatccgaggctgcgcccaagcgcgccctgtacgagtctgtgttcgggtcgggggaaatctgcggccccacttcccccaaaagactttgtatccgcccctcggagcctgtggatgcggtggtggtggtttccgtgaaacacgaccccctgcctcttcttccagaagccaatgggcacagaagcaccaattctcccacaatagtttcacctgctattgtttcccccacccaggacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggccttccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttg

SEQ ID NO: 23093 - DNA, 1747 bp, Homo sapiens
ccaccacctgcctcaccagtagctgggactacagctcccgtcactagctttttctcctcaagcctgcactgcacaccaactgggacggagggtgcagatgaataaaggcaaatccatcaccaaaagacagtcggcccaatatgtcaagacctctgatcactagatcccctgcatctccactgaacaaccaaggcatccctactccagcacaactcacaaaatccaatgcgcctgtccacattgatgtgggcggccacatgtacaccagcagcctggccaccctcaccaaataccctgaatccagaatcggaagactttttgatggtacagagcccattgttttggacagtctcaaacagcactatttcattgacagagatggacagatgttcagatatatcttgaattttctacgaacatccaaactcctcattcctgatgatttcaaggactacactttgttatatgaagaggcaaaatattttcagcttcagcccatgttgttggagatggaaagatggaagcaggacagagaaactggtcgattttcaaggccctgtgagtgcctcgtcgtgcgtgtggccccagacctcggagaaaggatcacgctaagcggtgacaaatccttgatagaagaagtatttccagagatcggcgacgtgatgtgtaactctgtcaatgcaggctggaatcacgactcgacgcacgtcatcaggtttccactaaatggctactgtcacctcaactcagtccaggtcctcgagaggttgcagcaaagaggatttgaaatcgtgggctcctgtgggggaggagtagactcgtcccagttcagcgaatacgtccttcggcgggaactgaggcggacgccccgtgtaccctccgtcatccggataaagcaagagcctctggactaaatggacatatttcttatgcaaaaaggaaaacacacacaaccaataactcaaacaaaaaagggacatttatgtgcagttgggacagcaaaccaagtcctggacgtaaaatcgaataaaagacacatttatatccaatagagaccacacctgtattcatatgggaacaattggaatagtgatatcctcaaggtgtaaaaaatatataaatatatatatatatgtcaaaaggtaggaaatgcaaaaaagaaaaaaaaaaaaggtgacagccgcagttggtgctgtgatggccgtgaagtgtcctgggccttccgaggcctctgacaaataaacaagccatgagtggtgaggacacagtctccttacagtttccattgccaacaacagccatccatatttcttttttcctttgtctttctttttcctttttttttaaaaaaacaaaacaaacaaaacaccttgaatcaagtttgtttgtatatggaggttccacgtctttctttaggcagggaccaggcaggacttcagaaaaaccctcatgagcacattgcaaagatgttagacatgaaattttaaatgtagtttgtacagaagtcacacttttttgtccacctcacagatgtgaactttactttgttttaaaactgatcagttttgccaaggggccagaattattccttgttagaattgctccagttcaagtctgctgctttcctacaatttttcaaattttataatgtattaaatacaataaactctgtttaaaaaataaggtctgtgtgaaacacacatgtgggggtgaggctggattaaagtgaaattttttctttttgaaa

SEQ ID NO: 23094 - DNA, 4163 bp, Homo sapiens
acaccttgcctcccctctggcagctgaaatagcggaggtgggataaatgccctccccagccgagaaaagctggaacccactccggccggggaggctggaaagaaaactggcccctaggcgcacaacggacggcttaagacgttgccctctgcggggcggaagtggggtgcggacagcggaagttatcgctccggccccgcctccgcccccggctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatgactgaatgtcaaaatcgtgtattgggcagatgctttttaaactgtcgtgtgagaaacttttatattaggccatttggattttattaagtgctaaggaaagagggcttacaaaatgtttcgtaaatattttatactgtttaagtgttaaacaccaaccctgtctttcttttgggttgagcttttttagaaagtcgaagtgaatgttggccaggaaaatggaaaagccattgtataaatttttttttgaggcggagtcttgctctattggccaggctggagtgtagtggcaccatctccacttaccacaacttgtgcctcctgggttcaagcgattctgctgcctcagcctcccgagtagctgggattgcaggtacccatcagcccatgcccagctaattttgtatttttagtagagatggggtttcaccatgttggccaggctggtcttgaactcctgaccctgtgatccgaccaccttggcctcccaaagtgctgggattacaggtgtgagtcaccacacctggctgcatagtgttttaaatgtttgtgtgaagaatgagtttgtggaacaatttgatttgctgtggcctctatgcctaatgagctagtgtttctggcagctctctctacccaactttgcacttgtagttttgagtctttgtctctctggaatatgaacaggtttataaaacattccatggtgaacaattctgtcggctgcattatagccatgagtgaatagacagcattggctggtccaagctctgttattgagtatacaaggaactgatttttcttatgttagcactaagggcaaaaaccaatatttataatgtaagcactatccaggtaaaacactggcccaagatttggtaaagagatttcattgcaatgtaataactacagttttttacaaattggaacagctttggtgtgtcgtaatcaagggttttttttgtttgtttgtttcaaataagccatctgattgtggtgactggggcccatgtccaagacaattcctggcatattctgtcaccctcccgtggggcgatcactgtgtggggaccccattccccagttaaagtgtgtctctgtaccttacaacagcgattcaggacccaagtgtgaacaacactcagcccgccctctggagcgtgtgctgtctttagggccctacccaaagtcactgtaacagttaagtgtgtcattaacctttctgtctctttgcgccataaaaaaatgctcaaagttttagatgtagccactgtatgttgtacaaacgttggcgacatgtaaaataaaagtcataaaatgc

SEQ ID NO: 23095 - DNA, 2467 bp, Homo sapiens
gctggcgtgagctgggtgtttcctgcctctctcagtccgggtttggagactcctgcgtcctccgacttttcatggaagagatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaagaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatg

SEQ ID NO: 23096 - DNA, 1030 bp, Homo sapiens
ttagatattgcaggagtcccttctggagtggttatggcaacttctactccctgcagaagtctggatttttgccaacccttggcactgtccaaccttttaattattgcaaatctggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgaccc

SEQ ID NO: 23097 - DNA, 866 bp, Homo sapiens
agatgtcaggagaaagtgtggtgagctcagcggtgccagcggctgctacccgcaccacttccttcaagggcacgagccccagctccaaatacgtgaagctgaatgtgggtggagccctctactataccaccatgcagacgctgaccaagcaggacaccatgctgaaggccatgttcagcgggcgcatggaagtgctcaccgacagtgaaggctggatcctcattgaccgctgtgggaagcactttggtacgatactcaactaccttcgagacggggcggtgcctttacccgagagccgccgggagatcgaggagctgctagcagaagccaagtactacctagtccaaggcctggtggaagagtgccaggcggccctacaaaacaaagatacttatgagcctttctgcaaggtccctgtgatcacctcatccaaggaagaacaaaaacttatagcgacttcaaataagccagccgtgaagttgctctacaacagaagtaacaacaaatactcatataccagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtga

SEQ ID NO: 23098 - DNA, 5355 bp, Homo sapiens
attctcccagtacagttcatcacagttttggttaaattcagagtttacgtcatgacgtgtaaatacggctgacagttaagccacagagtgtacagtgattattttctttcttctataactttaagtttgccagagttagggattgcctcattgttttgttcacttggttttctaaatatatgttcctacttcagccccacgttctcagcggtctcatagtggtgtgttcagacacatcagaggttctgtttcatctttgtcttggagacatgcccctgggtctcgtttctgttagtctaaggttagacctccaggactgacctcctaattctttcctcttagtgtctctggctttatccttttgttctactttctcagaagttttatttttcaccttttcaacccttctatcaaaattttcatttctgcttcgtctttctaacttcaggagccttttcttgctgtccgaatgccctgctttccacagcgtgctcatcttgtttcctaggaggccgtatctgctctcaactgtctgatgattctgtttgttttctttcttctcccttcattatctgactcctcctcttttcctgtctttgttttggttttgttctcatgttaaagaggcttttcacatgtaatctgatgatgcttggctgtctgttgaaggaatgagagactctgaaagctgtttgtgcatggaaggtccttgttgtccactgggctgcattgtgggtgataaggcagactttttcagcgggacccccaactgtcagaatctgtaagccattttgggggaagcaggtggtgttcctgaagaggaatcctctactctcctcctgcctgacgggtctaggcctggccggctgcctttggggatctggaaggggaaggagctggggttgctcatcacttagtgtgatgttcacttgtccccccgttttcagaatcgcagctcagccctgtcctctaccgtgcaaaccactgcaggaagatggccctttcttctgcctgcatggggacggagatggatttggggatctttccagtgcttccgcccactggtttcagctttccccctctccttggttaacgctcacctgtgacctttctaccctcaaatttttgactttttttactggtctgctgacctcacttctcccattctttttccccttatgggtttatgcttttttttttaattcctctgcagtcatggtagtggggttttaggagcttttgattaaaacacgtttctgctgccacgtcaagggtttatttttgagtggcttcctgggctgtggaaaatgtgtcatcattgttagtacttactcagcatcctggcctatcatggtcatagccaaagagcagacttactgggaaattcaactccctgtcttcccccatctagttcactggtggtgagaatccttctctcttcccagccatgactgccccatctcccctcgccagagcctgtccagccggtcaactttaaaaatgcagtgctaggcaggcctcctaggctgaaagcatgttttgttccagcagaacaaagatacttatgagcctttctgcaaggtccctgtgatcacctcatccaaggaagaacaaaaacttatagcgacttcaaataaggtatgttggaggcacccttgtggaatttcttttgctaccagaaatgatggaggttcttctgaataacttttgaaataaaaacatgtataattgcctgagtgaggcctgataatgggttcacagtgggaagctacaggtcatcttttgtgcccctgctattgggtcatgtggtccccctctccagccagcaagctatgcttgtctgcctcttctgatgcagggcagggccccagccctatgggaagctagtagttcattgcatctgcctgccaagtaactctcttcttcttcttttaaaacaacccacagccagccgtgaagttgctctacaacagaagtaacaacaaatactcatataccaggtaaggcgtcagccgggaaagacagctccatttactaggaaaacctccactcacaccagccaggcccagctcttcttcgtaccttcagatgaggatgacccctctgtacctctctgcctggatagataagtagacagatggatacaggggtataactctgagctataattcacacatatcataaaagtcatctttctagagtgtacagttattattatattcacaatatgtggtttttatatattcacaagttgtgaggccataacgactatctaattttagaactttttcactgcctgaaaagaaaccctctattcgttagcagtcactccccattttccctcaaccattgcttccccaaccccacagccctaggtaaccactaatctgttttctgtcttgatgaatttgcctgttctggacatttttatgtgaatggaattgcataatatatggccttttgtgaccagattccttcattcagcataatgagattacctaagaggttttcaaggtttatccatgttgtagcatgaatcaatacttcattcctttttatggcagaataatattccacagtgtagaccacattttctttacccattcatcagttgatggacatttgggttgtttgcactttttggctattgtgtgtaatgctgttatgaacattcatgcaaagtctctatgtggacttacgttttcatttctctgggaacagaattgctgggtcatgtggtaattctatgtttaatcattcgaggacctgccaaactgttttctaaagtggctgcaccattttacattcccaccagcaatatatgcaggtttctagaatgccatttggcccttgaaaacatgtggctctaactcaggaacttgagggatgcagggaggatttaatcaggttactcaagatctttaaaaagacctaggatatagagtctcccttgggcagtgccattctgctcctcttggggctcggtgaggtgctctcctccacctggtgcctgtgcccagaggctgtcactcaagcacaatggttaggagcactcaggcttaggggccagggctgtcttttggggggcgtgtctgccatttattaggttcagccttgagcaattacctaatttctctgatcctcactttccttcttgagtgatggagattggagtgcctttgtcatgggattattgtgaggttgaaatgaggtagtggagaaagtgggctcagtagggccctgcgtgtagaagggcccagcaaatgatggcagtttttaccagcttgtggtcaccgtatcaaatgctcttttgcagcaattctgacgacaatatgttgaaaaacattgaactgtttgataagctgtctctgcgctttaacggaagggtcctgttcataaaggatgttattggggatgaaatctgctgctggtccttttatggtcagggccggaagattgctgaagtctgttgtacctccatcgtctatgccactgagaagaaacagaccaaggtggagtttcccgaagcccggatttatgaggagaccctgaacattttgctgtatgaggcccaggatggccggggacctgacaatgcgctcctggaggccacaggcggggcggcggggcgctcccaccacctggacgaggacgaggagcgggagcggatcgagcgcgtgcggaggatccacatcaagcgccctgatgaccgggcccacctccaccagtgagcaggcaagagaccgagccgccctcctctcaccgcccccactccctgccgtgctacacccagatcctgtgcaggctgccgggccccttctgcttcccttggagcctggagatacttttgtaacaagccagatgattattttggtattgcttgacaaggcaaattgattgtcttgacccaggcgtatgacccctgtcgttgaacaagctgtgtctaagatctctacttttcatgagaatctgagactctttggagccaggctttctcggttctcagaggaaaagtatgaatgagtgtgaagtgtatgtgagaacttttgtttgcaatatttatttttgtgggtgtcgacttcctatgtgggctttttgggtgacactcccttaagggttcagtttgacaattctgagagttgtcctgcagttggaggccaccagaggtatctgagctccctgcttcctatttcataatcctccagccccagcaggtccactcctggttcctgtgtgtttggcccgggcacaatccccactgctttgctagacgtgctttctgccatgtggctttgggcctagagcttgttgataattgcagcttgtggcagtggaaatatggctgaatgagcgtctaaatcgttgagaccagtgcaactttgggtgcaaggctttgtttagggatcaagccttttgccaccttgggctggtctttggcctggtgctcactgggaccccatatgtctgcgtaggagcagaactttccatggcagtaagtgtccagctctgtttctggttctttccccaactccagccccgtccagttgttctcctgattgacccgactccactccaggaaggccatctgaccctgtgacaggcatagctcataaactacccctccctgggatcccgctcctcttcagcctccttccccatgaagctgggctaactttctaagtcattttgcttagaaattcagtgtggcccataccctttgtcctcccagcctggcatccaggcagggacaccctcacaccaccagccccagggagcttccctgctataaacacagacccccttgtctttgcctctgatttttacacagtgtagagtggccagcagtgaacaggttgaggatgtgcgggtagatagataactttgggtctggtttgtgtctgtgttcatgtttgtttaagggatatgtgtgactgtgggtggggacgtgtgcttgtggggcacaggtggcggcccctgctggagcccggctgggcgcagcgcctatgtaggacgggtgttctcagtgacctacctcccaggctcctctgcacctgcaaaggaacaggagtgagtcgtgactgacaggggtggttgagactagactaggtagagtagttaccaggagatgtgaatgtgcgtcaggtgatggatgggtttgtcaagggaatcgttaccgttttataccaaaggtattaacatgggcagcctttgacacatgtattccaaaaacgagtttatattttcaaacggtttttacagcttagactttgtacttactgccctgcctgtgacagttgtatgccttcattttgtatccaacagcaaagtctacaataaaactttaaaacaatcatg

SEQ ID NO: 23099 - DNA, 1721 bp, Homo sapiens
gcagctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccatcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactg

SEQ ID NO: 23100 - DNA, 2528 bp, Homo sapiens
gggattgggtgctaggtcccacgacattagctgggattctaagacctttgctcagctgctgcggccaccactgacacgccctctgctcctcaaatacggagaacagttcagtgttcctgcctgaggatctctgcatttgccttccctctgcctggaactcttccctcacatccgcttcccagcttcagctcggcatcacctcctcagagaggccttccatccttggtgcccgggcaccactgctacccgttttggcctctgttttttttttttttttcaaaggacgttatgttgcccaggctagagtgcaacggtccgatcacggattactgcagcttccaactcctggcttcaagcgctccttctgcctcggcctcccgagtagctaggcttacaggctggggttacaggtgtgagccacagcgcccggccgctttggcctcctttaagagcttccctccgcgctttgttcgcagttctggtcacagtctgttcagtgcgcggggctgggaggcgggaaactgcccaatgcccagacctctctgtctgtttcccctcaagctcgtgaagctctctgacagcagagacccaatcacgaggtggagacttcgctttccacatcgggcagggggtcggccgcatcctcgatctggtcctggtgactcgagaccagagaggagcgcacgtcgacccgcccggggaacccgcaggccacacgccaaacctctacgggatcccccagcgaggccactgcgcatgctccatactcgcagccccgcccccattcaggggcggggccgcgcctgcgcagctgcccggcgccggcttccgggtggtgcgagcgagatggggcggagggccggtcttgcagagtagctgcggtgagtgggcgtgtgcgccgagcggtctggcccaagggctgggggccggccgagggtcttcgggagcaggccgcagggcgcggagagatcctgggatcgccgtccgccgctgctacccggcatgtcggcggaggcctcgggcccggctgccgccgcggccccgtccctggaagcccccaagccctcgggtctcgagcctggccccgccgcctacggtctcaagccgctgaccccgaacagcaaatacgtgaagctgaacgtgggcggctcgttgcactacaccacgctgcgcaccctcacgggacaggacaccatgctcaaagccatgttcagcggccgcgtggaggtgctgaccgatgccggaggttgggtgctgattgaccggagcggccgtcactttggtacaatcctcaattacctgcgggatgggtctgtgccactgccggagagtacgagagaactgggggagctgctgggcgaagcacgctactacctggtgcagggcctgattgaggactgccagctggcgctgcagcaaaaaagggagacgctgtccccgctgtgcctcatccccatggtgacatctccccgggaggagcagcagctcctggccagcacctccaagcccgtggtgaagctcctgcacaaccgcagtaacaacaagtactcctacaccagcacttcagatgacaacctacttaagaacatcgagctgttcgacaagctggccctgcgcttccacgggcggctactcttcctcaaggatgtcctgggggacgagatctgctgctggtctttctacgggcagggccgcaaaatcgccgaggtgtgctgcacctccattgtctatgctacggagaagaagcagaccaaggtggaatttccagaggcccggatcttcgaggagaccctgaacatcctcatctacgagactccccggggcccagacccagccctcctggaggccacagggggagcagctggagctggtggggctggccgcggggaggatgaagagaaccgagagcaccgtgtccgcaggatccatgtccggcgccatatcacccacgacgagcgtcctcatggccaacaaattgtcttcaaggactgacctctgaccctccccctgccttcctcttgccttgggacccagtccctctctctttccctccccttcccagacttttgccccggctctgctggccaagtcgtgggtcctcctctgtcccttcattgcatggcacagctcactttggcccttctccacccatcccaaccccattgctaacaacatggtacattccggccccaccactcagagccttccgaagccaacacttgtccccaccctggccctgcgtccttccctctccagctggttaagagggatttagaattccctttctctttttttagtgcatcgtccatgccaaagtgtgcggcccttcctgacatcaccacagtctgagcagcctcccgcgtcctgcagggtagtccgccccctcctccccaccatcctccctacctccttaactttgtactagactggcctgggcctgcccagctcagcgttatcagtctgtttcatattatttattattttaattttctattaaattattgaaataaagttaagttgagaaactg

SEQ ID NO: 23101 - DNA, 5645 bp, Homo sapiens
ccgaggaggacgtgactcggagctgcctccgctttctccaagccatattcctttaagatgatgtaatagtcatttccctggatggtttcttgcctgcactgctgaaacaacagcatccgaactgcactgggaactgtggaaccacccagctccgccgccagagaagccggagccccgggccccccgccggcatctctgcgctgcgttggcctctggctcgcaccggctcccacctggctgggaacatgggagtccgtttgcccttgccggcaggtggggtggctacctgggaccctagcagggcacatctctccatctttctgcttctgggctttctgaaaagcttctaagtcctggtacctcttgcaactctcttctaaggatcctttccaaagatttctttttccatttttcttttcccctggggaagctttggttgaatattttctctgctttacttcttcaacccaacctcctctcatcagggcttaactttttttgcgacttgttttaacttaagatacggaatgaacacatatgtacctacatacatacataaatacaaataggcatttatataaatgcatatatataatagttattttccaagagcacacctctctggcacttttcattgatacctcggtcgtttacctgtttgggatttgacaagatccagactcagtttggctgtggattttgattgctttacaaatggttattattatttttttcacaagaactgggtctccagcactcactaagacggacatctgagtaactggggaattggcctgccttgcatgtgagcttgatggaagattggatatagacgagttgattatattttatgaagtagcagctcactaccatccaccatccagggtttaaactactttttcagcatcacttcacctgtggactcttatacattttgatttcttgggggaaaaatactgggataagaggaggtcattttttaataagttagcatccttttccctttcttacaagttgatccaaaggataaggctgtgactccattggattgcacctttaaatcaaaatagcagcagcagaagaaagggacaatggctctgagtggaaactgtagtcgttattatcctcgagaacaagggtccgcagttcccaactccttccctgaggtggtagagctgaatgtcgggggtcaagtttattttactcgccattccacattgataagcatccctcattccctcctgtggaaaatgttttccccaaagagagacacggctaatgatctagccaaggactccaagggaaggtttttcattgacagagatggattcttgttccgttatattctggactatctcagggacaggcaggtggtcctgcctgatcactttccagaaaaaggaagactgaaaagggaagctgaatacttccagctcccagacttggtcaaactcctgacccccgatgaaatcaagcaaagcccagatgaattctgccacagtgactttgaagatgcctcccaaggaagcgacacaagaatctgccccccttcctccctgctccctgccgaccgcaagtggggtttcattactgtgggttacagaggatcctgcaccttgggcagagagggacaggcagatgccaagtttcggagagttccccggattttggtttgtggaaggatttccttggcaaaagaagtctttggagaaactttgaatgaaagcagagaccctgatcgagccccagaaagatacacctccagattttatctcaaattcaagcacctggaaagggcttttgatatgttgtcagagtgtggattccacatggtggcctgtaactcatcggtgacagcatctttcatcaaccaatatacagatgacaagatctggtcaagctacactgaatatgtcttctaccgtgagccttccagatggtcaccctcacactgcgattgctgctgcaagaatggcaaaggtgacaaagaaggggagagcggcacgtcttgcaatgacctctccacatctagctgcgacagccagtctgaggccagctctccccaggagacggtcatctgtggtcccgtgacacgccagaccaacatccagactctggaccgtcccatcaagaagggccctgtccagctgatccaacagtcagagatgcggcggaaaagcgacttactccggactctgacttcaggctccagggaatcgaacatgagcagcaaaaaaaaagctgttaaagaaaagctctcaattgaggaggagctggagaaatgtatccaggatttcctaaaaatcaaaattccagatcggtttcctgagagaaaacatccttggcaatctgaacttttaaggaagtatcatctataagggagggctgggggcgggaaaagaaaaaaaaaagtcattttgaaattaacctcctaaaaggaattcatattttaaaggaaaaaaatacaactaatgatgcacatttcttagaacacaatagtccattgatatactactgcctactttacctagttcaccttaacatgtaaatccacagggtagatttctttctagatgtggaagtacaagaaaatcttttttagttatttgtttgtttacttcgtcccatgtgctaactatcttatatataatgagagccagctacgtaaaagtagctgagaggccttgggagtcatttatcccaaactgggttttttctctcatccttctacctccctcctttgaatgagggtatggtagaaaaagatctggcccaatggcataagtttggaatttttaattttggtttttccttttgtttatggggttggggggaatggcagatttatatgacttttcactcaaatctatatgtgccagtttatattgactccgtatgcatgagtatttgtgcaacacaagcacaactaagtatgtatatacacatgacgcacacgatgccagggcctagacctcccaagggctgtgctcctgctcccagcagccctctcttagaatatttcagatggatgagcttctgactctttcttaaaattcttttgggaagatttcccagcctttcttcacaacactttctaacatcaaatgactctcatcatcaacaaattgtattccttattgtgaaattaataccctcaggctccattttactgctttgctctttgtctgcattaagagaggatgaggagagctggtcaaacattccttgtgttaaaaaaatcaaacattcatatccacaaaattttctgctaaatgactccacactcagccttctctaccctgaactgaattatcacccttttctccatgttttcagagttcttactgcccacagtttaatggtgtggcctttccacataatccacattaagttctgtgttcctgtgttgttgtggaactaaggacaacacacagtacttgaataagggtccggccttttgtttgttttagagaaagttgtattccacacacaacctaataatttcttataaaaattttaaactacaaagctacatttttacttgcttgtagccgtttttgtttgcctttgggattcgggctttggctgtgcccatgctaggatttagctgtgtcatttttatgatgtctgtaacaacccaacaaggtaactgaagctccagagttaaggtttcagatttctaaatgaaactatctttttcaattacatcctgacttgtatagacacagccaaaaagaaactgttaatagccatccgtccatgtaactctgtattttactaaggtaccaatagctctttcatagacttgtgctacaagaaggttaaaagaccagttttattttcagcattcctcatgcatttcagtggtaaccaaaaaataatttgtcaattaatagttgtgtgccaagcactcctaatttgttttattgcgtgtgtgtgcatgtgtgtatgtgtatcacaggtaataaaggcaattggatgatatctgtaggaggaaaacaatgactaatttcttccttttgaaatctttcattgatgcacatttattatgtaagatgttctgtcttgatttctgttcttagtgatgattagtatatgaatatctttctgaatttttgtaattctcgccttcacactaggatgacagactcagctaatgtttccttgtcctgaaggtttgaatggagttgaaagttttacataagtgaaaaagaaagtttatcttgggagttgagttgtcaagagaattataatttatgaatttaagtggtattcttttctgtattaatatattagcagatatttggtcttaactacaacatagctttgtttgtaaacttaccagtatgtcttgattcttttcaatgtttcttgatagcacatggcaataccatcatcctaataacagaagatcttgcaaagaatcacagagcttaatgggtcaagaagttgaatttggggaaaatatcctgaaactcactttggtcaaatgattattgtgttgtcactggaagtactgtcaaagactttgggggtctaactaaaatggccaaagttccaacttccttaaatttcagacctgactgtaatggcctcaagatagagagatacccttataagagtaaagaattaagatgatagtcaacccaatatttctactacattctttaaacaggaaattaaacactgcaaaaggagtgttcgtggcagtgttcctctgacccctgacctgtcatgagttttctctgctctgacattccttatacatccagtgaacaaagctggaatagaaaacctgtttaaaaccatcacaacagcaatatttttattctgggccacctctcgactggcactcatcccatggtaaaatattcaagtaactaagacaacagcatggcatttatttgtgtgagtgtttatatagaaatgaacatagacctggccagtaaaaggctctgaggaggcttaaagtacctagtttgagtggagttatcaagtgaggtccaggtagcctgcaacactggaaatgagttctgggtaagtgagttataagagtacatgctctagtaactctggtagtcactgtgactcgggcatgtttccctgaagttaaaatagtttttagaactttttgtttaattctgaagaaaacaatatatatggtttacttctcgaacattggttatgacaagggccataaattgctaatataaagaagttagtagtattgagtggatacaatgaatggggaatcacatgtgtagagccccaacttagattgccttctgggaaatcccgcgatactaaaatccagtgagctttgggagatcattccctaaaggtatgtgggttgtctgaagtcagaaacatatttacaaagtccttctacccactatcaaaaatgaactgatctgcattcagcaggaaaaggggaagacaggaatgtaaaactactagatcatatggtattgtgattttctttcccctgctaggaaaaaattgcactgaaatgctgacaaaaaataatgaaatgaagtggcttccaaaatatgcactgatgttatcctttgtatttataggcacagttatcttactgaaaatgcatgcatggtgaattaaaataaaagggggaacaatgcacaaat

SEQ ID NO: 23102 - DNA, 2313 bp, Homo sapiens
agcaattgctgcttactcgtaggtaggaggaggagtttctcagacctaggtgatggaggaagactgggaggcgctaaaatgagacagacggagtcccctctcctgtccacaaactacaatgcctacaatgcctcggtgtcagcatttactgtgattcaagcactgtgctaaagtgtttttcatatgtcatgaaaagttgtgccagaaaattatggtttgaacatgggcagttttctcctaccgtcagctatatccacaagcatcacatgaagtggagatctggcagctctgtgtatttcagtcaagttccacaatgaaacctgacaataatggtaaaaaccaatacggacatctgagtaactggggaattggcctgccttgcatgtgagcttgatggaagattggatatagacgagttgattatattttatgaagtagcagctcactaccatccaccatccagggtttaaactactttttcagcatcacttcacctgtggactcttatacattttgatttcttgggggaaaaatactgggataagaggaggtcattttttaataagttagcatccttttccctttcttacaagttgatccaaaggataaggctgtgactccattggattgcacctttaaatcaaaatagcagcagcagaagaaagggacaatggctctgagtggaaactgtagtcgttattatcctcgagaacaagggtccgcagttcccaactccttccctgaggtggtagagctgaatgtcgggggtcaagtttattttactcgccattccacattgataagcatccctcattccctcctgtggaaaatgttttccccaaagagagacacggctaatgatctagccaaggactccaagggaaggtttttcattgacagagatggattcttgttccgttatattctggactatctcagggacaggcaggtggtcctgcctgatcactttccagaaaaaggaagactgaaaagggaagctgaatacttccagctcccagacttggtcaaactcctgacccccgatgaaatcaagcaaagcccagatgaattctgccacagtgactttgaagatgcctcccaaggaagcgacacaagaatctgccccccttcctccctgctccctgccgaccgcaagtggggtttcattactgtgggttacagaggatcctgcaccttgggcagagagggacaggcagatgccaagtttcggagagttccccggattttggtttgtggaaggatttccttggcaaaagaagtctttggagaaactttgaatgaaagcagagaccctgatcgagccccagaaagatacacctccagattttatctcaaattcaagcacctggaaagggcttttgatatgttgtcagagtgtggattccacatggtggcctgtaactcatcggtgacagcatctttcatcaaccaatatacagatgacaagatctggtcaagctacactgaatatgtcttctaccgtgagccttccagatggtcaccctcacactgcgattgctgctgcaagaatggcaaaggtgacaaagaaggggagagcggcacgtcttgcaatgacctctccacatctagctgcgacagccagtctgaggccagctctccccaggagacggtcatctgtggtcccgtgacacgccagaccaacatccagactctggaccgtcccatcaagaagggccctgtccagctgatccaacagtcagagatgcggcggaaaagcgacttactccggactctgacttcaggctccagggaatcgaacatgagcagcaaaaaaaaagctgttaaagaaaagctctcaattgaggaggagctggagaaatgtatccaggatttcctaaaaatcaaaattccagatcggtttcctgagagaaaacatccttggcaatctgaacttttaaggaagtatcatctataagggagggctgggggcgggaaaagaaaaaaaaaagtcattttgaaattaacctcctaaaaggaattcatattttaaaggaaaaaaatacaactaatgatgcacatttcttagaacacaatagtccattgatatactactgcctactttacctagttcaccttaacatgtaaatccacagggtagatttctttctagatgtggaagtacaagaaaatcttttttagttatttgtttgtttacttcgtcccatgtgctaactatcttatatataatgagagccagctacgtaaaagtagctgagaggccttgggagtcatttatcccaaactgggttttttctctcatccttctacctc

SEQ ID NO: 23103 - DNA, 3696 bp, Homo sapiens
tctccctgccgagaaatgggccggcccggctgcgcgcgggcagcagcggtggcggcggcggtccaagatggcggaactgcagctggacccggcgatggcggggctgggagggggcggcgggagtggggtgggcgacgggggtggcccagtccgcgggccccccagcccacgcccggctggccccacgccccgcgggcacggccgcccggctgccgccgtcgcgcagccgctggagccgggtcccggaccacccgagcgggcagggggcggcggcgcggcccgctgggtcaggctgaacgtgggaggcacctacttcgtgaccaccagacagaccttaggccgggagcccaagtcatttctctgccgcctctgctgccaggaggacccggagctggactcagacaaggatgagacaggagcctatctgattgacagggaccccacctactttggtcctatcctcaactacctccgccacgggaaactcatcatcactaaggagttggcagaagaaggtgtgctggaggaagcggagttttacaacatcgcgtcccttgtgcggctggttaaggaaaggatacgggacaatgagaacagaacttcacaaggccccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagcctcctcgagccaggtgctcctgggcaccttcagaagtgatgtcctgtgtgctccacagctcacctgcttgccaaggtacgtctgggtagtagtttctggaaatgactgcagactgtgccaaatgtcttttgagcttctgacctgaccatgcccagatggcataacttttccctaggaccctcagtctccttgtttctctgtatctgtagcatagcatagaacccggtatacaggggtttctgctgacacatcaacgtctacacacctatgcgccacattttacagctgtaaagtgttagatgaactgccgtcctcagtaaaagcagccaccccttcaagagtcacaggcatccatccagtcgtatctttcagagaaaaaaaaagttagatgtagccaaggaaagtagtgatcacgggaaggactgctctgagccgggtaggatggaggactttggaagaggcgctccttggccaggtccaatgagtaacatcagactgacagaggaaaagcagcttggtttgcggccttgtgcccagtctcgttgaggcgcttgtccctgtctgctttcctggggcatgcctgatcagcgtgggctggagctcctagaccaaccccagctttctcaccaggttcagcaaggaggcctgggggtcagacaccaatgttgagcacctcctgagggcgccgtttccttcattcctcttagattccatagttgccgccatgaaaagactgctcttgagccccaaggcacaggcacgtgctctgggaaatagacaggagtggtatttccgccctctcggagggctggtgttcaccaagtttccctcctcgctgcaacccaatgacacctgtattgttccagcgctccaggactctgggttcttaagatttctgggagcgttgttcacccaccccctttaggaaccaggctggtgttcttgcttgaaagcgttgtgccctctgagtgtctggctgatcacatcagagaggtctgcgtggcagtttggggctgtcacgtgaccagtgacccacactctctgctgcccagtactgccaagtggggagggtcctgcctttttctctgccccaggtctgggacgcaggtgatgccagccaggcccaggagtgcccagcatcccccaactgatgacacagtagcactgattctgtcttttcctcagaatctggcctttttccatggcaatgaggtggggcccagcctcctctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctc

SEQ ID NO: 23104 - DNA, 3575 bp, Homo sapiens
tccctgccgagaaatgggccggcccggctgcgcgcgggcagcagcggtggcggcggcggtccaagatggcggaactgcagctggacccggcgatggcggggctgggagggggcgccgggtcccggaccacccgagcgggcagggggcggcggcgcggcccgctgggtcaggctgaacgtgggaggcacctacttcgtgaccaccagacagaccttaggccgggagcccaagtcatttctctgccgcctctgctgccaggaggacccggagctggactcagacaaggatgagacaggagcctatctgattgacagggaccccacctactttggtcctatcctcaactacctccgccacgggaaactcatcatcactaaggagttggcagaagaaggtgtgctggaggaagcggagttttacaacatcgcgtcccttgtgcggctggttaaggaaaggatacgggacaatgagaacagaacttcacaaggccccgtgaagcacgtgtacagagtcctgcagtgtcaggaagaagagctcacgcagatggtgtccacgatgtccgacggctggaaattcgaacagctcatcagcatcggatcttcctataactacggcaatgaggatcaggcagaattcctctgtgttgtctccagagaactaaataattctaccaatggcatcgtcatagagccgagcgaaaaggcgaagattcttcaggagagaggatcgcggatgtaaactaagaccccgaaaactccagaccttcaggagagcagtcagcagagcccctctgtgaagtgaaacctcactcctgtccagtgaccgagccactgcaaagcacagctgatcctggccccctgtgaagaagtgttctggtcaaaactaaaggaactccctccccacctgcaggactccgaagacagtgcgacttctggctgcagaataccttttcagaaacctgctttcatttgcttagccagtattagaacagatctttacaacagcagctgggctgggttcccagtcggagcctttcggggatctgggggatgagggcggaaggcctagctccttggaaatggcctgtactttaaggacgctggagccaagaggattgttcccgtgccgtgccatggtttcaccctatgtgtgccacaatggacgttagcagctgcttcggaacaccgtccctcctatgcaccctccaagacgtgcagcagatgcaaagggttctagctgcagtttgtcgaattgaggttttaggtaaagcatagagttgccagagtaccccgcattcccatgaatagagcctccaaggaaagggaggatggggtgtcctttgttgtggttggaggttggtgatcattgctctggatttggggctcccggctgccaccacatgcagctttgcctcacctttctccagcagccgggaccctctggagagcttgttttccctccaagaagaggtttgagacaggcggcatcctgcactgagtcagacaagtgggagctgtaggaactgcacctgcagcctcttcttactccccattgaccctgtcttccttccctggctttttcaactggaccaaagatgaaggcacttatggaccctttgatggcttggagtggggaaggctgtttctttgaaagttgccaaatgtgttatgttgtgtctcagagagagttatttctgtgactctcttggaaatgccttgactgaatgtgcaatatttgtgtctcttggtttctaaccttggcggacctgctcccctctgtactgtccccagtggtatgtatgtatgtgctaggcagtctggggaccccctgtgtctctgaccacccccctgacccccgccattactttcttttctggagtgccatgctggcgaggatccggatgcggcagcaccctctttcgggctgcatccacagagtttgtgtccacactttctctccgagcatgtgggtctcgctgagcagtcatggaatgcggtagagccaggggaccctgtctgccccgaataactttcagtagtatggcagatggcacagagaaagggaaggggctctggggacttctccttctatgaaagcctcctcgagccaggtgctcctgggcaccttcagaagtgatgtcctgtgtgctccacagctcacctgcttgccaaggtacgtctgggtagtagtttctggaaatgactgcagactgtgccaaatgtcttttgagcttctgacctgaccatgcccagatggcataacttttccctaggaccctcagtctccttgtttctctgtatctgtagcatagcatagaacccggtatacaggggtttctgctgacacatcaacgtctacacacctatgcgccacattttacagctgtaaagtgttagatgaactgccgtcctcagtaaaagcagccaccccttcaagagtcacaggcatccatccagtcgtatctttcagagaaaaaaaaagttagatgtagccaaggaaagtagtgatcacgggaaggactgctctgagccgggtaggatggaggactttggaagaggcgctccttggccaggtccaatgagtaacatcagactgacagaggaaaagcagcttggtttgcggccttgtgcccagtctcgttgaggcgcttgtccctgtctgctttcctggggcatgcctgatcagcgtgggctggagctcctagaccaaccccagctttctcaccaggttcagcaaggaggcctgggggtcagacaccaatgttgagcacctcctgagggcgccgtttccttcattcctcttagattccatagttgccgccatgaaaagactgctcttgagccccaaggcacaggcacgtgctctgggaaatagacaggagtggtatttccgccctctcggagggctggtgttcaccaagtttccctcctcgctgcaacccaatgacacctgtattgttccagcgctccaggactctgggttcttaagatttctgggagcgttgttcacccaccccctttaggaaccaggctggtgttcttgcttgaaagcgttgtgccctctgagtgtctggctgatcacatcagagaggtctgcgtggcagtttggggctgtcacgtgaccagtgacccacactctctgctgcccagtactgccaagtggggagggtcctgcctttttctctgccccaggtctgggacgcaggtgatgccagccaggcccaggagtgcccagcatcccccaactgatgacacagtagcactgattctgtcttttcctcagaatctggcctttttccatggcaatgaggtggggcccagcctcctctaaagtgactttgtttctgcacagttgtaactgctcttggggatgtcagtgaggctgggagcagggagccacgggatgctgagagaggaggcccgagaggacaccccaccctccagcgtggcctttgatccagacttagggacgaggctgtcactggtgggcaccctctgttcctgtttgtgtgtttgaatagtctgaaatgctgtgactttttttgtgtgaataaagatatgaaacttctgaatctc

SEQ ID NO: 23105 - DNA, 3855 bp, Homo sapiens
gtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagaatatgtgagatccaggctgttgactgtactacaatatcctcatttacagtgagggaatgtgagggatccagtaggatgggctcaagaccaaggcgctacttgttcacaggccatacaaatggcagtattcaaatgtgggatctgaccactgctatggatatggttaacaaaagtgaagataaggatgtaggtggtccaaccgaagaagagctactcaaattactcgatcaatgtgatttgagcacatctcgctgtgctactcctaacatcagtccagcaacttccgtagttcagcatagccacttacgagaatcaaattctagccttcagcttcagcaccatgataccacccatgaagcagctacttacggttccatgaggccttacagagaaagtcctttattagcaagggcaagaaggactgagagctttcacagttatagggacttccagactattaatttgaacagaaatgtagaaagagctgtccctgaaaatggtaacttgggtccaatacaagctgaagtgaaaggggcaacaggggaatgtaatatatctgagagaaagtctcctggagtagaaataaaaagtttgagagaattggatagtggattggaagtgcataaaatagctgaaggtttttcagaatccaagaaaaggtcatcagaagatgaaaatgaaaataaaatagagtttaggaagaaaggaggatttgaagggggaggattccttggaagaaagaaagttccctatctggcgtcatcaccaagtacttccgatggaggaactgactcacctggtactgcgtccccatctcctacaaagactactccatctcctcggcataaaaaaagtgattcttcaggtcaggagtacagcttgtgaaaactcaccaaaatgaatagttgtttcgttacatttagatgaaagttaaactttactgaatttcagtacattagtttttacactaaaactttacaagataaaattggacttcatttagtatctttttaacagaattacttggaataatgagatacaataatcatatctcttttgacattttggaaatttttttaattttacaagtacatttaacagatcatttataaagcaggagtccattttaacacttaccgactttttttggtttggaaacatattaccacgtcttaataggatggtgcccatataggtgagcatccctttagatcatgggaaccagcagactgcattcctaatcttcattatgcctgagacttgtcttacaatgttacctttaagtgaatcacataattgtctttggaacttggtctcccaacacttattgtgattgcaaagtgtttaccagatatttgatgaggtgctatgtttgtgaaaaacatatcatgtaattcaaaaacactattgatattgaataccagataccactatgtagtaagtcttttaggatgattttaatttagtcgtgcgtcattttctgattctcatcattgggagatcttaaatcttagcaagcattagcaatattaaatgccaaaattccattgaaactttcaagttggagcaattgtctgtgtttgaaaagatgaaataaaaataataatcaagggcaaagctttgagtgcccagaagggaaagctgtaccagttgctaacctgtcttgtttcaggagccaccatgtttttttttcagtgttaacaacaatcatgataattaaattaaaacactagtttgttcacttgtaggactgcagttctgaattttgggttaaaggttttggctgctgtaagaatgtgaatttgaatgtattttgaattgtaagagcaaaagaacgtttttgtacaattttttttcatttaattggaatgatcttcaggtttctacaaatagggtaattgtaaatttaaagcattagcatttattggtgaataatgtatatatccccattccaagaaatataagtgagtgaagttgaaataaaatctttaaaattta

SEQ ID NO: 23106 - DNA, 1017 bp, Homo sapiens
gtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagagtgttttggctgggcacggtgggtcacgcctgtaatcccagcactttgggaggccgagatgggtggagttcaagatcagcccgaccaacatggtga

SEQ ID NO: 23107 - DNA, 1905 bp, Homo sapiens
gtcggtggcagcggagcacggagaagaggcccgggcggcccggcggcctggaggccgcgaaaggtggaggccgggccgcccttgtgcaccgcaggattgacccgggaaggggcagaagctagcgagccccgcccggccgccgggaaggtgggggaagccccgtgcaccccccgccctccggccgccgccgccccgctggccctgcagccgtcgccgctgcctcgggctacagccccgggctcggcggtcccggctggggaaggagggcggcgagcgcgtccggagccgccggagatggcgggagggcactgcggcagcttccccgcggcggcggccggcagcggcgagatcgtccaactgaacgtaggggggaccagatttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagaatcaaagaatcttcaggatggcagcaagtgtttacgagcccatatttggattggactatcgaacgagtagctttaaatgcaaaggtggttggagggccacatggagacaaagacaaaatggttgctgttgcctcagagagtagcatcatcttgtggagtgttcaggatgggggaagtggaagtgaaattggagtgttcagcctgggtgttcctgtagatgctctcttctttattggtaaccagttggtggccacgagtcatacagggaaagtgggagtgtggaatgctgtcactcagcactggcaggttcaagatgttgttcctataactagttatgacactgctggatcattccttctgcttggatgtaacaatggatcaatatattacatagatatgcagaagttccccttgcgaatgaaagataatgatcttcttgtaactgaactgtatcatgatccttcaaatgatgctattactgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagtctgtgtggtgtcagtttggtttctagatccagccaagagcccacataa

SEQ ID NO: 23108 - DNA, 751 bp, Homo sapiens
atttagtacctcaagacaaactcttatgtggattccagattcttttttttccagtttgctgagtgggagaatttcaacacttcgagatgaaactggtgctatatttattgatagagatccagcagcatttgcacccattttaaattttcttcggacaaaagaactagacttaaggggagtgagtattaatgttctcaggcatgaagcagaattttacgggatcactccattagtaagaaggcttctcttatgtgaagaattggagcgttcctcttgtggcagtgtcctttttcatggttacttgcccccaccaggtattcctagtcgtaaaataaacaacacagtcagatctgctgattctaggaatggtctaaattctacagaaggtgaagcccggggaaatggtacacagcctgttctctctggaacgggagaagaaactgttaggctaggatttcctgtggatccacgaaaggtgctaatagtagctggccatcacaactggattgtagctgcatatgcccattttgctgtgtgttacagagtgttttggctgggcacggtgggtcacgcctgtaatcccagcactttgggaggccgagatgggtggagttcaagatcagcccgaccaacatggtgaaaccccatctctactgaagatacaaaaattagccaggtgtggtgatgcatgcctgtaatcccagctactcgggaggctgaggcaggagaatcacttgaacccaggaggtgg

SEQ ID NO: 23109 - DNA, 589 bp, Homo sapiens
tgctctgagtgtttacctcacacccaaaacaagtgtcagtggtaactggatcgagatcgcctatggtacgagctctggagcagtacgagtgattgtacaacacccagagacagttgggtcaggtcctcagctttttcagactttcacagttcaccgaagtcccgtaacaaaaatcatgctatcagagaagcatcttgtatcagtctgtgcagataataatcatgtccggacgtggacagtaacacgattcagaggaatgatctctactcagccaggttctactcctttagcgtcattcaagatactatccctggaggagacagaaagtcatggtagctattcctctggaaatgacataggaccttttggagagcgagacgatcaacaggtgtttatccagaaagttgttcccatcaccaacaaactatttgtaagactctcatcgactggaaaaagtctgtgtggtgtcagtttggtttctagatccagccaagagcccacataactaaaagggcatttggagaatatgtgagatccaggctgttgactgtactacaatatcctcatttacagtgagggaatgtgaggg

SEQ ID NO: 23110 - DNA, 4873 bp, Homo sapiens
agctgggcgcgagcgggtcggcgttgagggagccaccgccctcccgcctgcgcactgcctctcgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtggtgagtagccccggtaggcgagagtcccatcagggaggatgtccaccttgcttggtggctctgggagtaagatccctgaaggggctgctgactgccccagaatctgccgaggtgagaacagcatcctgaggcacagctcccaggggacagaggtgtagctccaatctccctgactgcacctcagggttgggctcagggcttgcggcctgcaggcactccagccagcgctcacctggcctttcctcaaggcatggtagtctttccttgaggctgatagctagggcttgaccaggaagtcccgagaagttttgtcaccttcttgaccttgcaagagagtttctgcccattttagagccacgttaccaaatcgatgtaggcctaatcacttcctcaaccctgttcaagcgtccctcccttgtgctcagtatattggtgtgaacacggaacatgatgggggatttacctgaccagccaccccatagcccctggctgaagaagaaagagcatcttctctcccactgcaccccttctcctccaagaatagttgcccacattcccaaaatgtggaaagacttttcttttccttccggaacatgttcttcaccaccttttggagatttaaccatagctgccaaagctatgcacccagttggccttagaaaaccacaatgtttacagccctgtcttagggccgcggcttctcttatcttccaccaccttccttgcttgcagggttatcttctcacagggctggaatgcaaatttcagaggcttcttttgaagattccccaagtcaagcaggcaagatgcctagatcttctgttatctttgacatgtaacatcctttttagaggctcagaacacctccttggctgctatctcatgtgttagaatccagtttgtggtgaacctctttggaaggggaccccctctctttaaaccctgttcctctgtcctggtaacattctccttctaggagagcctctcttctgagaaggtaaaggaagggctgggtgagacacacagctatcctaggagccgtaggaagacaaaacttcccttttgttttactcctcactcctctatttttgttttactcacttctttatattttgttttactcctcactcctgtatattttggtttacttactcctctatttcagaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaatcatgattgtacctgtctcttcctgggtaaagggagatttttttttttaatgtgtaaagaattgatgcgagccaggaacatgtctgtagtcccagctacttgggcacacgcctgtagtccaggccactcgagcacacacctgtagtaccagctactctggaggctgaggcaggaggatcacttgagcccaggagattaagactgtagtatactatgatcgtgcctgtggctagccactgtgctccagcctgggcaacaccatcgtaaaaataaataaataaataaataaattggggaggacagcctcactggtatcagacttacaggaccagatagacaagatgggtataaggggagctgaagtctgtgttcatatgaggaagagaagaccaagccctgggactttggctgaattcctccgtggggctggacggcagtgatctcctgttccctatgtgtaaacaaagattccagggcgtggttttgcactcctgttgtactcttttagaggtggaaaagaggtggatactgagatctaagaggaaaggatagtcattcacgttctgagatatgcgctctctctattgttctcgtacacaaagggatagtctcttttctggagctgatgtccctgcttggaggttagccccaaaacatggctcttgtattgttctaagagaaaaggctttcattttggttcttctgattggtgttacctactgcctaatatgtgttcattttttgacagagaggcagactattgaaaaagtctgtgtgaacagagagcagttcattaagcccattgctttcagtaatgtggccttgaccccttctgcttcccccttctcccatggagcatggcagggcttggttatttagagtccatacatgcaagccattgagagacttgtttgctcaaatgcaagtttgctcaaaaacaggtcctgaaggcttgcttaggattacagggatgctgggtaagaacaccgttcctctctctcgctggagaaatccctgtttctctgactccctttgtgatcctcacagtaatgtattctgtgccactgtaggacacaaggctctgggccagtagaacaggcagagaggtgacactgggcagcaagctgagagctctttctaaatggagtgaaggaattcagtggcctagtttcgccattctctaatgagaaaccaaggccaggctgaaaagtgcaattagatgtggtggattgtggtaacggcctccagataaaggggttatccctgtggaagtgacttttccccatttgatcccttttcaactctaaatggccaggcccagaacagaagaagggttgggtctggaaggaaggctccaaaggatgaaagcttctccctgatcataaggaagtgcatctttatagaattgttgtgcataatgtcagtaaatccctctcacttgacaagggactggattcatcttgccttgagacgggccagtagttatcagtgagtcaaagcaaagtgaaagtttcaggagatgggaccaatggtgcaatgctcgccataacaaaattccttaaaaataaaaaagctaatgttatagcaacaaaaaaagactgaagcaaaaccacactgaaatgcatcccactccaggagaggaattcttagcgtaacactctaaataaatggaaggaatcatcaccttccttattttacctctgccttgttcaccaggctgcccagtgcttaccatgcagaaagcagtcagctgtactctggaagtttctgttcttctttcctggggcttaggatattctgggagctgtctgagccttgtgcctaaggcttatcaggtgatataatcttcctgttctgggctgcttgctggaggaataggaagtgacatttataagacacaggcggtgtgagcatccatgtgtggtcttggtctaaaccagctcttgaacaggttaaagcaaacagcaataacaaaacaaaaactactgatgctgagcgttttgatcctagtaatatttcaaatattgtccttctgcatatgttctatccatatttgattccaatatacattattaagctttcttgggtactattttgctggggctcttgcgtgaaggtggtacctgtctcatgatccttaaaagagagaggcttttttcatccaaagctgtagtgttgggaactggggtgggagaggcactttttggaattctgaaagaatcatatctgtgtatatacatactgagtggggaaggatgggggttggcaggggttgagggaggtgggaacaaacagtgagtatgggaacaggcagtcacctcgagtgtgggaggtcacctgggtccgtcgtcttccttctgtatggtgttgggtttatgtacacactataacacttcctgtgtgagttcatgtacctgtctgtgagtgctttggtgtattgagcctcagtacactccaagggcattaaagtcaagaactagaacctg

SEQ ID NO: 23111 - DNA, 4042 bp, Homo sapiens
aacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgggtcttgctctgttaccctggctggagtgcaatggtgcaatttcaacttactgcaacctctgcttcctgggctcaagtgatcctcctgcttcagcctcccaatgtgctgggattacaggcactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagagaggagatttcaccatgttggccaggctggtcttgaactcctgacctcaggcgatccacctgcctcagcctcccaaagtgctgggaatacaggagtagagccaccgcacccagctgtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcc

SEQ ID NO: 23112 - DNA, 3925 bp, Homo sapiens
aacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgggtcttgctctgttaccctggctggagtgcaatggtgcaatttcaacttactgcaacctctgcttcctgggctcaagtgatcctcctgcttcagcctcccaatgtgctgggattacaggcactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcc

SEQ ID NO: 23113 - DNA, 1902 bp, Homo sapiens
agacctacccgggcgaagcgggcgagcggtggtttggacgccggcggagacgcgggcgagaaaactgtggatttagttactccactctgccatgtctttccaccactgcctgcacatttgagaccaaggatagagattgggaaaaattgatagttctcctgcctcagagtttggctcctgcactctcatttcagccatagctgcagacaaagcacacgattgctgggcactgtggctcaagagaaggaggagatgtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagca

SEQ ID NO: 23114 - DNA, 3805 bp, Homo sapiens
aacgtgcgttcgctggcggtgccgggggcggggcgagcaggagggtgggtgtgaggcgggagctggccgcggagcccagacctacccgggcgaagcgggcgagcggtggtttggacgccggcggagacgcgggcgagtggttagcaggaagaagatgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaaggaaattcaggaagcaaaagctcccagtccttccataaaccggcaaaccagcattgaaacggatagagtgtctaaggagttcatagaatttctcaagaccttccacaagacaggccaagaaatctataaacagaccaagctgtttttggaaggaatgcattacaaaagggatctaagcattgaagaacagtcagagtgtgctcaggatttctaccacaatgtggccgaaaggatgcaaactcgtgggaaagtgcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatgatcacaatttagtggagagtatttatttgagcctaaattgtaggtagcccttactacactcaactgattgggatctagaatgtaactaaattgcttataaatgtcagcattttttaaaggtacagtatatggggattgtttcgtttttcctagcaggggaaccttagttaataataaaatactacttatttgagttactgatacagattcatttaaggcttgtgtgcaaattttgtctcaatcttttttccctccatgattttcctatgtgcttcctctggcattcactgtggttttggtaaataattgccttttaaaggattaaacaaatgaatgctacaaagtgtatgttcaagaaaattaaatggtaccactcttccacagtttggaataattttataattgtaaagatagaaattatattgataagtaaatatgtaaaattgtaaatatgtaaaaaaaagaatggtgtctgctgtgcatggcattttatatgttaattttttagtttaaaatgaagtatattgaatgtttgcctttagcaccattttatttggtttgtcccactaaaatgactcgagaagtgtttagacaaactccccttaagatgtgcactccatctttaagaacgtgttagccttaactttgaggttctatatagtcagagactatgacaccactaaggttcagaataaagtttaggccacataaaattgctgtttaatgtagtcgatggaagactttaaactatgcttctagcttatttttccctcattcattcagcaaatctctattgagttcttcagtgagaaggagcaggcactgggcctggaatggaaggcgggaatgaatgggcctctgatggtgagaggtgacggggtccctcagctgtgagatgcaaggggcgccttgcagcctccataatatacatttgactttgcaaacgtctagacatgttttctgaacctttttcaggacatttcaacctcgggactattcatattagtggcctgagaggtgtttgttgtggggccaccctgtgcatggtagaatgttcagcagcattcctgccatccatatccattaggtgccagtagcacccccgctagagctgtgaaaaattctctccagacatagtcagatgtctcctggggccatatcacccctccgttaagaaccactgatgtcttttacaaaccaggagttatcctcctggtggttaatatggtgtaaccaaagaatcttgcactcaatgcacagtgtgatgttaactaaaacgagttaaatatttaggaggcttgacagctacctgcattgtagaaccttttcttatctcagtggaaccttctataacctaaatataccattgatgattcttcttccattcagtgacatccacagattatgcagctatacttgtgaaatcgtgcatgaggccccagggcaccgttctagaacaacgtcacttcacacaggcagctgagaaaggttctcttgcttttccagtatcttcctaaggatggagcccaaaattgcagagcagtaactttggaataaaaccagggtgggtataaaacttcttattcttaaatttacatataagatctattaagcttgacacatctgtgtcatcacgcactgaagacaggaagcagttcactgagtcagctggttcccaagctcgcacagaaggtgataagttactatcaaatgccagtgagaatcttcttatagaataacctgggcccaagtgattttagtacaaaacttgcccttctttggtttaattttctatgtgcttttaggtgtgaatccagatatgcggtcttaattcctttggaaatacacagttcgtttagttactgtacactctgtttgttcaataaactgcatatcaacttcccacaaaagctgacttttttgggtctcttacatataaagtaggttattgagttgatttttttggaggtatctcatattggtcgaattcttctggtatggactcttgccttatatagaggcttctatttctcttaagtcagcatcaatacaacggccggagtttctgtttttgcaataagaagatgttggtattttatgtagggtaaatgtgactggaatacacctttggaacggaattctttatcaataaagtttcacaatccgtccctcttcc

SEQ ID NO: 23115 - DNA, 1224 bp, Homo sapiens
atgagccttaagtctgaacgccgaggaattcatgtggatcaatcggatctcctgtgcaagaaaggatgtggttactacggcaaccctgcctggcagggtttctgctccaagtgctggagggaagagtaccacaaagccaggcagaagcagattcaggaggactgggagctggcggagcgactccagcgggaggaagaagaggcctttgccagcagtcagagcagccaaggggcccaatccctcacattctccaagtttgaagaaaagaaaaccaacgagaagacccgcaaggttaccacagtgaagaaattcttcagtgcatcttccagggtcggatcaaagaagcctccagaaagagtcgagaagataatggatcagattgaaaagtacatcatgactcgtctctataaatatgtattctgtccagaaactactgatgatgagaagaaagatcttgccattcaaaagagaatcagagccctgcgctgggttacgcctcagatgctgtgtgtccctgttaatgaagacatcccagaagtgtctgatatggtggtgaaggcgatcacagatatcattgaaatggattccaagcgtgtgcctcgagacaagctggcctgcatcaccaagtgcagcaagcacatcttcaatgccatcaagatcaccaagaatgagccggcgtcagcggatgacttcctccccaccctcatctacattgttttgaagggcaaccccccacgccttcagtctaatatccagtatatcacgcgcttctgcaatccaagccgactgatgactggagaggatggctactatttcaccaatctgtgctgtgctgtggctttcattgagaagctagacgcccagtctttgaatctaagtcaggaggattttgatcgctacatgtctggccagacctctcccaggaagcaagaagctgagagttggtctcctgatgcttgcttaggcgtcaagcaaatgtataagaacttggatctcttgtctcagttgaatgaacgacaagaaaggatcatgaatgaagccaagaaactggaaaaagacctcatagattggacagatggaattgcaagagaagttcaagacatcgttgagaaatacccactggaaattaagcctccgaatcaaccgttagcagctattgactctgaaaacgttgaaaatgataaacttcctccaccactgcaacctcaagtttatgcaggatga

SEQ ID NO: 23116 - DNA, 1160 bp, Homo sapiens
cgcccccctccggccagcccgcagccggccgcgtcatgccaggcgctgctcggcggtagggagtgcccggggccgccgcctccgcccgcccgaagccgcgcccactgcccagagccagagggatggtggtagtcacggggcgggagccagacagccgtcgtcaggacggtgccatgtccagctctgacgccgaagacgactttctggagccggccacgccgacggccacgcaggcggggcacgcgctgcccctgctgccacaggagtttcctgaggttgttccccttaacatcggaggggctcacttcactacacgcctgtccacactgcggtgctacgaagacaccatgttggcagccatgttcagtgggcggcactacatccccacggactccgagggccggtacttcatcgaccgagatggcacacactttggagatgtgctgaatttcctgcgctcaggggacctcccacccagggagcgtgttcgagctgtgtacaaagaggcccagtactatgccatcgggcccctcctggagcagctggagaacatgcagccactgaagggcgagaaggtgcgccaagcgtttctgggactcatgccctattacaaagaccacttggagcggattgtggagatcgcccggctgcgtgcggtccagcggaaggcccgctttgccaagctcaaggtctgtgtcttcaaggaggagatgcccatcaccccctatgagtgtccgctcctcaactccctgcgatttgagcggagtgagagtgacgggcagctttttgagcaccactgtgaagtggatgtgtcttttgggccctgggaggctgtggctgatgtttatgacctgctgcactgcctggtcacggacctctcggcccagggtctcaccgtggaccaccagtgcatcggggtgtgtgacaagcacctcgtgaaccactactactgcaagcgccccatctatgagttcaagatcacatggtgaaattgaaaaagatccccaaggatctgttactactgcatttccttcttgctctgtctacagcctaggccaactagtcagggtctggacatgcatctcctaaaggaagaactgtgtagcaccattgatcacaatgtaacatttccatgctgcattaagggtgtctctctctaa

SEQ ID NO: 23117 - DNA, 2001 bp, Homo sapiens
gataaatagcctgtcctgcaacctggcttaaaacagggaaagccggagttaggcaacagagtgcctagctttctcagtcattcaaacacaagcacggaagaagagattgcactgaccagaggaccgccagggtgtgatgctccgtagtcgcagggatgaaggaaaaccatgggcggagcttgtcatggacagctcctaggtggacataaatggaaactcattggttctggggcacggcgggaagagggagacggccctggacggccgcaccaagaatttcacaacccaaacccgactagaaagcctggggctcccaatattacaagtctgttcttgacaaggaagttgggatgacagaactactgtatgaaaactcagaaatgctcagaagtgcagacctttggttctgttttcttcctcatcagataggaattttttttaactacgcacagaatcacacttgcgaagtcttcttttccttcttgttactttatttagaagctgtgaactcaagaagtaggtcccatgttgaatctacatgtgcgcaggtgattcttttagccaagtcatttccacactcatgcccaagtctggagatacacaggtgcgggtttctgacaacatcaagatatgaaaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccat

SEQ ID NO: 23118 - DNA, 2161 bp, Homo sapiens
gcaggaagacggcgctgcccggaggagcggggcgggcgggcgcgcgggggagcgggcggcgggcgggagccaggcccgggcgggggcgggggcggcggggccagaagaggcggcgggccgcgctccggccggtctgcggcgttggccttggcggcggcggtggagaagatgctgcagtccctggccggcagctcgtgcgtgcgcctggtggagcggcaccgctcggcctggtgcttcggcttcctggtgctgggctacttgctctacctggtcttcggcgcagtggtcttctcctcggtggagctgccctatgaggacctgctgcgccaggagctgcgcaagctgaagcgacgcttcttggaggagcacgagtgcctgtctgagcagcagctggagcagttcctgggccgggtgctggaggccagcaactacggcgtgtcggtgctcagcaacgcctcgggcaactggaactgggacttcacctccgcgctcttcttcgccagcaccgtgctctccaccacaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacccagtcatctgcctgcgtggatggccctgcaaaccattgagcgtaggatttgttgcattatgctagagcaccagggtcagggtgcaaggaagaggcttaagtatgttcatttttatcagaatgcaaaagcgaaaattatgtcactttaagaaatagctactgtttgcaatgtcttattaaaaaacaacaaaaaaagacaaatggaacaaagaagctgtgaccccagcaggatgtctaatatgtgaggaaatgagatgtccacctaaaattcatatgtgacaaaattatctcgaccttacataggaggagaatacttgaagcagtatgctgctgtggttagaagcagattttatacttttaactggaaactttggggtttgcatttagatcatttagctgatggctaaatagcaaaatttatatttagaagcaaaaaaaaaaagcatagagatgtgttttataaataggtttatgtgtactggtttgcatgtacccacccaaaatgattatttttgtagaatctaagttaaacttactatttataatgcataggtaaccattaactatgtacatataaagtataaatatgtttatattctgtacatatggtttaggtcaccagatcctagtgtagttctgaaactaagactatagatattttgtttcttttgatttctctttatactaaagaatccagagttgctacaataaaataaggggaataataaacttgagagtgaataaccatagtattctgctgcaataaatgtttctaccctcttgcgatagaatggtgtcagatgtctaacatgtttataaacatttttttgaattgaacaggttatgaaaaggatttattaaaaggttaagatactttgttttgaaagtacattgtgatttgcagccacctagcactaaagcatagaacttaaacacgaatccctaaatgaacagattatgttacattaatctgagaattttaaatttagaagctaaaataaataaaaatcacagctggttgt

SEQ ID NO: 23119 - DNA, 726 bp, Homo sapiens
gtcctgagggttttatctcctgatttggttagaagattgttgaatctggctgtgagagcctttcaagtgcctaaaggagagagcttgaacttccctgagagtacaccaggttatggccacaccgtgcccttgtcagatggaggtaaggccttctgcatcatctactccgtcattggcattcccttcaccctcctgttcctgacggctgtggtccagcgcatcaccgtgcacgtcacccgcaggccggtcctctacttccacatccgctggggcttctccaagcaggtggtggccatcgtccatgccgtgctccttgggtttgtcactgtgtcctgcttcttcttcatcccggccgctgtcttctcagtcctggaggatgactggaacttcctggaatccttttatttttgttttatttccctgagcaccattggcctgggggattatgtgcctggggaaggctacaatcaaaaattcagagagctctataagattgggatcacgtgttacctgctacttggccttattgccatgttggtagttctggaaaccttctgtgaactccatgagctgaaaaaattcagaaaaatgttctatgtgaagaaggacaaggacgaggatcaggtgcacatcatagagcatgaccaactgtccttctcctcgatcacagaccaggcagctggcatgaaagaggaccagaagcaaaatgagccttttgtggccacc

SEQ ID NO: 23120 - DNA, 2396 bp, Homo sapiens
gcaaggcatggagcctgcactttactctgaatgttggtggcgccttcagagcattgttagcaagggtccatgtgatcacactgacacctgagagagtgacacaccatgtacatggctggtatatggaggatggatttaagggggacaggactgaaggctgtcgcagtgattcagtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataa

SEQ ID NO: 23121 - DNA, 2725 bp, Homo sapiens
gtgtgcgggtgtgtgtgtgcgggagtgtgtgcgcacacgccttcgggggctggagtgacactgcagtgggcttctccgtagccccagccttcaggctgcgcagcccctaacctgccggcaccgcttttgggaagcagcttggctcttccatctccccaagccttcctctccatcctttcatccacccctcgccgatcttactttttcttttacccacggggccgcggccggccaccccctggccggtgcaaacacccaagccctctccagttctcccccaagctaatattttcccacctgtctttttctggggttcctccacgagccagtccaaggctcccccatcctcggaaattgttttgttggactgctaaaccgaggcgtgtaaagcttgaggactttattattatttgggttcttttcatttcttccccttctgggcaacgaagcaatgaaatttccaatcgagacgccaagaaaacaggtgaactgggatcctaaagtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataa

SEQ ID NO: 23122 - DNA, 4835 bp, Homo sapiens
gcaggcatcgtctcctccggtctcacagctaccccgggctggagcgtggggagggggtaagggagccagccaactcggggaaacttcgttgccagagatgactggggttttcgggctttcccagccttcccatgccgggccacacggcattcattaaagtggtggggcaactattggtgcgctccagccgggcaggttttgagctgcagagacccgtgcccggtagcagcgctttgccaccgagtgcacccaggacgcagtggccgccagcccgggtctcctgctgggggccggcgagtgcagggagactttgcgccacgatgttttgttttcctgccgcaggaacgctaggcagtctctttccaccagacttaacccgcctgaagcaatagccatggaagttgcggcggcacagagggagacagaaccgcttggagcggcatctttcttggatgttttttctctacacagacttctttctttccttggtggccgttcccgcagcagcaccggtgtgccagcccaagagcgccactaacgggcaacccccggctccggctccgactccaactccgcgcctgtccatttcctcccgagccacagtggtagccaggatggaaggcacctcccaagggggcttgcagaccgtcatgaagtggaagacggtggttgccatctttgtggttgtggtggtctaccttgtcactggcggtcttgtcttccgggcattggagcagccctttgagagcagccagaagaataccatcgccttggagaaggcggaattcctgcgggatcatgtctgtgtgagcccccaggagctggagacgttgatccagcatgctcttgatgctgacaatgcgggagtcagtccaataggaaactcttccaacaacagcagccactgggacctcggcagtgcctttttctttgctggaactgtcattacgaccatagggtatgggaatattgctccgagcactgaaggaggcaaaatcttttgtattttatatgccatctttggaattccactctttggtttcttattggctggaattggagaccaacttggaaccatctttgggaaaagcattgcaagagtggagaaggtctttcgaaaaaagcaagtgagtcagaccaagatccgggtcatctcaaccatcctgttcatcttggccggctgcattgtgtttgtgacgatccctgctgtcatctttaagtacatcgagggctggacggccttggagtccatttactttgtggtggtcactctgaccacggtgggctttggtgattttgtggcagggggaaacgctggcatcaattatcgggagtggtataagcccctagtgtggttttggatccttgttggccttgcctactttgcagctgtcctcagtatgatcggagattggctacgggttctgtccaaaaagacaaaagaagaggtgggtgaaatcaaggcccatgcggcagagtggaaggccaatgtcacggctgagttccgggagacacggcgaaggctcagcgtggagatccacgataagctgcagcgggcggccaccatccgcagcatggagcgccggcggctgggcctggaccagcgggcccactcactggacatgctgtcccccgagaagcgctctgtctttgctgccctggacaccggccgcttcaaggcctcatcccaggagagcatcaacaaccggcccaacaacctgcgcctgaaggggccggagcagctgaacaagcatgggcagggtgcgtccgaggacaacatcatcaacaagttcgggtccacctccagactcaccaagaggaaaaacaaggacctcaaaaagaccttgcccgaggacgttcagaaaatctacaagaccttccggaattactccctggacgaggagaagaaagaggaggagacggaaaagatgtgtaactcagacaactccagcacagccatgctgacggactgtatccagcagcacgctgagttggagaacggaatgatacccacggacaccaaagaccgggagccggagaacaactcattacttgaagacagaaactaaatgtgaaggacattggtcttggactgagcgttgtgtgtgtgtgtgtgtgtgtttttaatattcacactgagacatgtgccttaaacagactttttagtccaaaattacatagcattgaagaatatatttcactgtgccataaacaactgaaagcttgctctgccaaaaggaatcagagaacaagaacttcatttcagatagcaaacgcaggacacaccaagagtgtccgtgcacgtagccggttctggccgtacatgttaagggcatttcagtggcagtgctgtacccctgggcagtgctacctgggcacacacgtagacaagggcagctattccttagaccagcctcctgaaagaaacaggtgtgtctttttagtggagtcgtagtaatatgtgcacacacagaaggggacctgattgggtgggagctggttatgtgtaactagcgttggagttgacattttggcatgtgctctgagcttgaattttgataccaaccattcagtgcatcatacctagtctttctatgctccaaatgaatgtctgtggggacctgagagcacctggaatttgttggaagcagatcagagcacacgtacgaaaaggtgcaattgcttttctcatgacaaaagaaaaaaaataatcacaaacacatcacactgtggatatcaccttaaccaatgacagaagcctgctgagtttggtctttctcacaggggtaggtagtccacatgaactggcgagcagtggtgaaaacatgacatcaactgctgcgtggttaaaggccaatcatgcattttcctcagtgggtgcaatggtgacaataaactgatttggaaatgtccatgtactttggttataacttgttttgataagaggggtagaaataccaaaacaattgccttgcatgatgccagtggcttgctgttctgtctagctgatcctacatttttacaaaagtagacatcctgcatttctgagacacactgaggaggaccatggcatctttccatctcagggctttttgtcccttgggtgtcttagggtagacatagtgataagatccaatctcgctatctccaaacaaaaagaaaatgtaccccttgtacagtaagcttgaaatgtttttattgcttgcagcgtaagtgccattaattccatttaacaatgatacttagaaatatttaaaatatttcattttacttttatgtttgggcattcctttattctgaaaaagtcaccactgctccttgcttgtttctacatctcacatcggttactcactaaaactggaacaccctagactgattgttcccaggcaaacgataagctaacacatcataattatgattggtctgtgaggctagaacatcccgcagaggaaagtcggggaatggctagtcataggttgcatgatgattttaaatgggtttgtatcagaaaggggaaaatacatactcctgtgtatgcctcagtctttatcataattggctggttcacagctagctctttgggccacacgtgaaagcatttggacctggcaacaccaggcagttgctggttatgggtgttctaggctcactgctaccttttacagagttcacgggattttacgtaactaacccgcagtgtggatttaccaaaagatcacagcactagcggagacttccagaaactgtctcatgctttctgacctccagggaaagttgtacccacgacatcctcaaccactggtaccatggaagacctgtccctgcccatttctcaaaaatgcacagctcttccctgcctggagcacatgaagtcccatctccctgtccccagacctttaggctctgttgaagttctggcattgcttatgagacccttcctgtccaaggaaggtctaagtcaactcctccattggactggagatgaggctcactggtgacatcctgtgtcgactcagtaataaatagtcacttgggaggcgatgtttatgcaggtgtggatgttgagttttactatgggaatcattccagcctgacaaaatgtgttttaaggaataggtagataactgggacttcctctgttattctaacaagtcgaagcttcctaattaaactgtccatggatctcacttatttggtttccactctgtgttatctggtacgttctttgtagcagtgtgttaaaattccaggccctacggccaaatctggcagaggcttccctctcatttatccagtgccttctgtgggccaggcacaggattaggcactttatgaacgtcagctcattgaaacttcacgacactatgtgggaagtatttgcaaacccattatatacacaaggacacagaggctcagggaagctatgttatttatccaatggcacacagcaagaaagtggtagagctggtattcaaagtctgaccaaagtctgctttcaacttcactacagtgtctgtgtcatgcatccttgtgattgtgtgtgtttgtgtgtatgtgtgtctttctagcttcatggacacagcttacagatgtggggagcagatatggtggaatctccaccaccaagagggcacaaggtctttgtgtaaacatggctcaaagggttgcccctgcagacacctactgtacatttatttggttttggaaattttgtatgtggcaccctttaaaaaatgccctttgaaagcactcttttgcactttacttgctaactttgtagaaactctgcatacagcaggaataaaatagttcaaagcactaagctgcatactcta

SEQ ID NO: 23123 - DNA, 2037 bp, Homo sapiens
gaaaggagcgcttccccggactcggctcggctccgaggctctgaagccgacgccgccagctcagccccgggggcgggagcaggactgcccgcacagcccgcacctaggaggcgccgatcccgaacgcctcatgggacgcccccgggggctctctccacgccttgctgccgcgtcccggtcctaggcgcccgggatccacggcccaccccgcccgcagcccgcggcctgtctggagaggagtatgaggcccggggccccgcggacgccggccaccgggcggcaggggcctagctgcggagccccgcgcccgagagcggcgggtaaggagccgcgggagccggcgaggcgtcggggcgcgcagaggagcgcccctgcccgggcacccgctgggccacgggactcgcgtgtggcctgagcgccggggaggaggcggaggcgcccctctgtccgggctctgggaaggcgacgaggggctctgcgaaggcggcgaggggctccgcggcggccccggacccctggccaccatcctcacgctcctgctcccgccggggggatgtcgtggcccgggccccgagcgccgccccggccccggggctgagctccggaccatgtcctcccgcagcccccggcccccgccccgccgtagccgccgccgcctgccgcgcccctcctgctgctgctgctgctgccgccgttcgcacctcaacgaggacaccggccgcttcgtgctgctggcggcgctcatcggcctctacctggtggcgggtgccacagtcttctcggcgctcgagagccccggcgaggcggaggcgcgggcgcgctggggcgccacgctgcgcaacttcagcgctgcgcacggcgtggccgagccagagctgcgcgccttcctccggcactacgaggccgcgctggccgccggcgtccgcgccgacgcgctgcgcccgcgctgggacttccccggcgccttctacttcgtgggcaccgtggtgtcaaccataggtttcggcatgaccacccccgcgacggtgggcgggaaggccttcctcatcgcctacgggctgttcggctgcgctgggaccatcctgttcttcaacctcttcctggagcgcatcatctcgctgctggccttcatcatgcgcgcctgccgggagcgccagctgcgccgcagcggcctgctgcccgccaccttccgccgcggctccgcgctctcggaggccgacagcctggcgggctggaagccctcggtgtaccacgtgctgctcatcctgggcctgttcgccgtgctgctgtcctgctgcgcctcggccatgtacaccagcgtggagggctgggactacgtggactcgctctacttctgcttcgtcaccttcagcaccatcggcttcggggacctggtgagcagccagcacgccgcctaccggaaccaggggctctaccgcctgggcaacttcctcttcatcctgctcggcgtgtgctgcatttactcgctcttcaacgtcatctccatcctcatcaagcaggtgctcaactggatgctgcgcaagctgagctgccgctgctgcgcgcgctgctgcccggctcctggcgcgcccctggcccggcgcaatgccatcaccccaggctcccggctgcgccgccgcctggccgcgctcggtgccgaccccgcggcccgcgacagcgacgccgagggccgccgcctctcgggcgagctcatctccatgcgcgacctcacggcctccaacaaggtgtcgctggcgctgctgcagaagcagctgtcggagacggccaacggctacccgcgcagcgtgtgcgtcaacacgcgccagaacggcttctcgggcggcgtgggcgcgctgggcatcatgaacaaccggctggccgagaccagcgcctccaggtagaccgcccgtccgcccgcgccggggaccctctccaggccgcggggccgccgggcgtggtttgcttctctcagtcactgctggcgctttcttaatctttatccaataaaatgaaacaaaaaaaatttttttaaagaaa

SEQ ID NO: 23124 - DNA, 2522 bp, Homo sapiens
cgggaaactcgagttggctcgagcttgccctgaagacgcgccacgccccctcccctatctgagccggacagggagccggggtggaaactgcgcccgcatcccagcgccaagcagacgtgaactctgcgcccgttccccgggaccttcagcgttaaggagaactccgaggagagcagggggagtggaggggaacggcggcgacaaagcggatttgaaactaggagtcaaggaggacgtggggagctggcgccacaggagctaccgaggcggcggccgggggagcctcgcggcctgcgggagagcccggcggtcatgggcgagccggcggtggggcgcccgggagctggctgagcgccggggcccttatttcccgggggtgtgggcgagactccgccgacgcccggtgccgtgggcctgggggctgcccccgggggcccggccatggctggccggggtttcagctggggcccgggccacctgaacgaggacaacgcgcgctttctgctgctggccgcgctcatcgtgctctacctgctgggcggcgccgccgtcttctccgcgctggagctggcgcacgagcgccaggccaagcagcgctgggaggagcgcctggccaacttcagccgcggccacaacctgagccgcgacgagctgcgcggcttcctccgccactacgaggaggccactcgggccggcatccgcgtggacaacgtccgcccgcgctgggacttcaccggcgccttctacttcgtgggcaccgtcgtttccaccatagggtttgggatgacaactccggcgacagtaggaggaaaaatctttctgatcttttacggccttgttgggtgttccagcaccatcttgttcttcaacctcttcctggagcgcctgatcaccatcatcgcctacatcatgaagtcgtgccaccagcggcagctccggagacgaggggccctgccccaggagagcctgaaggatgcggggcagtgtgaggtggacagcctggccggctggaagccctccgtgtactacgtcatgctgatcctatgcacagcctccatcctcatctcttgctgcgcctcagccatgtacacccccattgaaggctggagctactttgactcactctacttctgttttgtggctttcagcaccattggctttggggacctggtcagcagccagaacgcccactatgagagccaaggcctctatcgctttgccaacttcgtcttcatcctcatgggtgtctgctgcatctactccttgttcaatgtcatctctatcctcatcaaacagtccttgaactggatcctgaggaaaatggacagcgggtgctgcccgcaatgccagagaggactcttgcgatcacgcaggaacgtggtgatgccaggcagcgtccggaaccgctgcaacatctccatagagacagacggggtggcagagagtgacacggacgggcgccggctctcaggggagatgatctccatgaaggacttgctggcagccaacaaggcctcgttggccatcctgcagaagcaactgtctgagatggccaacggctgcccccaccagaccagcacactggcccgggacaatgaattctcagggggggtgggagcctttgcaatcatgaacaacaggttggcagagaccagtggggacaggtagaagccaggagtggatgctgggcagaggccagagtagaatggaggatgattgccgcccaggggacgagctcagccctgcgccttggctctgttccttctgggagctgttcccgggagcctccgcaagcatctttagaaatctgatctcggctccaaccaacagccaccttccagggatggggggcctgaagcctcgatgcttgtctcctgatccttattctttaagtctaaattcagtcttttcaaaacaaatcacaaaagcagcattagacattgccttgtttcattaatcttgtttcagagctttagctgcctgaggagataggttttccttaagccttgatttcctgaagctctctctgttccttatttgggaacaaaaattgcgaagactcatctttccctagaactctgaatggatgaatttttaaaagtggggagaatgtttggggatgtgtctgggctttctttttgccaggcttccttcaaagcatacctgccaatggtgtctgcatagggaaaatgtctgttgtactctttatacctgtttctgttttttgttgtccctttctttttatttttaaggccttaatgcctggctgtggcgtctgtgagacctcaatgtaataagaaaattaaattcagcttcaggcctttaaactgcagcaagatggtggtgtaggggtgtgggacggggagagactcacttttgtaactaaagaacatagcttaacattttccctttgaatggtcacacagaccatttcatttttaccagggcttggggacccaatgcaaagatgatgactatttaataaaatggaaaatttaataaatcctcattttattaactaa

SEQ ID NO: 23125 - DNA, 1320 bp, Homo sapiens
ggttcccggcagtcgccccgcctcgcccgtcacaaccctgccgcgtggggccggggttggagggggcggagcgcgcggtccgggcacacggagcaggttgggaccgcggcgggtaccggggccggggcgccatgcggaggccgagcgtgcgcgcggccgggctggtcctgtgcaccctgtgttacctgctggtgggcgctgctgtcttcgacgcgctcgagtccgaggcggaaagcggccgccagcgactgctggtccagaagcggggcgctctccggaggaagttcggcttctcggccgaggactaccgcgagctggagcgcctggcgctccaggctgagccccaccgcgccggccgccagtggaagttccccggctccttctacttcgccatcaccgtcatcactaccatcgagtacggccacgccgcgccgggtacggactccggcaaggtcttctgcatgttctacgcgctcctgggcatcccgctgacgctggtcactttccagagcctgggcgaacggctgaacgcggtggtgcggcgcctcctgttggcggccaagtgctgcctgggcctgcggtggacgtgcgtgtccacggagaacctggtggtggccgggctgctggcgtgtgccgccaccctggccctcggggccgtcgccttctcgcacttcgagggctggaccttcttccacgcctactactactgcttcatcaccctcaccaccatcggcttcggcgacttcgtggcactgcagagcggcgaggcgctgcagaggaagctcccctacgtggccttcagcttcctctacatcctcctggggctcacggtcattggcgccttcctcaacctggtggtcctgcgcttcctcgttgccagcgccgactggcccgagcgcgctgcccgcacccccagcccgcgccccccgggggcgcccgagagccgtggcctctggctgccccgccgcccggcccgctccgtgggctccgcctctgtcttctgccacgtgcacaagctggagaggtgcgcccgcgacaacctgggcttttcgcccccctcgagcccgggggtcgtgcgtggcgggcaggctcccaggcttggggcccggtggaagtccatctgacaaccccacccaggccagggtcgaatctggaatgggagggtctggcttcagctatcagggcaccctccccagggattggaaacggatgacgggcctctaggcggtcttctgccacgagcagtttctcattactgtctgtggctaagtcccctccctcctttccaaaaatatattacagtcacaccataagcacaaa

SEQ ID NO: 23126 - DNA, 789 bp, Homo sapiens
atgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggtctgaggcaaggctgtggagccaaggcggctccaggcaggagacccaggagaggctctacagcagcaagaggagtccaagtcacaccccaggacttccccatatccaagaaaggactgggaagctga

SEQ ID NO: 23127 - DNA, 1248 bp, Homo sapiens
gtcctggccacagcatgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggcacagaccccagcaagcattatatctcagtgtatcggagcctggcagccatctggatcctcctgggcctggcgtggctggcgctgatcctcccactgggccccctgcttctgcacagatgctgccagctctggctgctcagtctgaggcaaggctgtggagccaaggcggctccaggcaggagacccaggagaggctctacagcagcaagaggagtccaagtcacaccccaggacttccccatatccaagaaaggactgggaagctgaggacccacggactcttcacacagcctagacgcttcctccactccaggtagagggatttcgggggccttctcagaagcaaggagtggacaagcctcttggttaaggctcctcttacctcccaagctcatggacaagtggcaatcagctggggtccctcttttggggtacaaaggaaaggacagaggtgtgggagacccaaggtggtcttgagattgacagacagcaagtccttggagatagcccccgagtccaagaacttaggcaggggccccaagacaataaagttggtctctactatctccta

SEQ ID NO: 23128 - DNA, 1272 bp, Homo sapiens
atgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggccacccccttaacttcatcactccctctgggctcctgccttctcaagagcctttccaaacaccccatgggaagccagagagccagcagatcccaggatccttccagaaagtgagctccatgaacgtctggcctctctcaggaatgcattctccaggtctggcctttcccctgccagactgcaacatccctgaccaggagagatttagaccactccatcccggggcctggaaattttggcctttgcctctcccatcatccaacagcaagtgggctcctatgtggctgggttcctctgcacaggtctgaggcaaggctgtggagccaaggcggctccaggcaggagacccaggagaggctctacagcagcaagaggagtccaagtcacaccccaggacttccccatatccaagaaaggactgggaagctgaggacccacggactcttcacacagcctagacgcttcctccactccaggtagagggatttcgggggccttctcagaagcaaggagtggacaagcctcttggttaaggctcctcttacctcccaagctcatggacaagtggcaatcagctggggtccctcttttggggtacaaaggaaaggaca

SEQ ID NO: 23129 - DNA, 981 bp, Homo sapiens
tctcccccatagccagccccacggccctggcagggtcctggccacagcatgcccagtgctgggctctgcagctgctggggtggccgggtgctgcccctgctgctggcctatgtctgctacctgctgctcggtgccactatcttccagctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggcacagaccccagcaagcattatatctcagtgtatcggagcctggcagccatctggatcctcctgggcctggcgtggctggcgctgatcctcccactgggccccctgcttctgcacagatgctgccagctctggctgctcagtaggggcctcggcgtcaaggatggggcagcctctgaccccagtgggctccccaggcctcagaagatccccatctctgcatgaggcccccggggggggcccagaaacccctttcatcctccccagtcccac

SEQ ID NO: 23130 - DNA, 889 bp, Homo sapiens
cagccttcaagggtgaagacgctgggggcggccgagagagcccactggggcctggacagagtgagcacacctatccgatttagcccagaaacatctatccaacttggagacagagagagagacatgaagcactcaggagaacctgctgctagagaggcaggcggaggctcagtccagggaccagtttcagttggagaagctgcgcttcctggagaactacacctgcctggaccagtgggccatggagcagtttgtgcaggtcatcatggaagcctgggtgaaaggtgtgaaccccaaaggcaactctaccaaccccagcaactgggactttggcagcagtttcttctttgcaggcacagtcgtcactaccataggatatgggaacctggcacccagcacagaggcaggtcaggtcttctgtgtcttctatgccctgttgggcatcccgcttaacgtgatcttcctcaaccacctgggcacagggctgcgtgcccatctggccgccattgaaagatgggaggaccgtcccaggcgctcccaggtactgcaagtcctgggcctggctctgttcctgaccctggggacgctggtcattctcatcttcccacccatggtcttcagccatgtggagggctggagcttcagcgagggcttctactttgctttcatcactctcagcaccattggctttggggactatgttgttggtctgaggcaaggctgtggagccaaggcggctccaggcaggagacccaggagaggctctacagcagcaagaggagtccaagtcacaccccaggacttccccatatccaagaaaggactgggaagctgaggacccacggactcttcacacagcctagacgcttcctccactccaggtagaggg

SEQ ID NO: 23131 - DNA, 1658 bp, Homo sapiens
acacatttgaggcggggccagatgcccacagttcagagcctctttttgtcccggggattggatcccagggctgggtggggccaggctgtcccattccccaacactcctcctccccggcgaaaccgggcaccagcaggcgtttgcgagaggagatacgagctggacgcctggcccttccctcccaccgggtcctagtccaccgctcccggcgccggctccccgcctctcccgctatgtaccgaccgcgagcccgggcggctcccgagggcagggtccggggctgcgcggtgcccagcaccgtgctcctgctgctcgcctacctggcttacctggcgctgggcaccggcgtgttctggacgctggagggccgcgcggcgcaggactccagccgcagcttccagcgcgacaagtgggagctgttgcagaacttcacgtgtctggaccgcccggcgctggactcgctgatccgggatgtcgtccaagcatacaaaaacggagccagcctcctcagcaacaccaccagcatggggcgctgggagctcgtgggctccttcttcttttctgtgtccaccatcaccaccattggctatggcaacctgagccccaacacgatggctgcccgcctcttctgcatcttctttgcccttgtggggatcccactcaacctcgtggtgctcaaccgactggggcatctcatgcagcagggagtaaaccactgggccagcaggctggggggcacctggcaggatcctgacaaggcgcggtggctggcgggctctggcgccctcctctcgggcctcctgctcttcctgctgctgccaccgctgctcttctcccacatggagggctggagctacacagagggcttctacttcgccttcatcaccctcagcaccgtgggcttcggcgactacgtgattggaatgaacccctcccagaggtacccactgtggtacaagaacatggtgtccctgtggatcctctttgggatggcatggctggccttgatcatcaaactcatcctctcccagctggagacgccagggagggtatgttcctgctgccaccacagctctaaggaagacttcaagtcccaaagctggagacagggacctgaccgggagccagagtcccactccccacagcaaggatgctatccagagggacccatgggaatcatacagcatctggaaccttctgctcacgctgcaggctgtggcaaggacagctagttatactccattctttggtcgtcgtcctcggtagcaagacccctgattttaagctttgcacatgtccacccaaactaaagactacattttccatccaccctagaggctgggtgcagctatatgattaattctgcccaatagggtatacagagacatgtcctgggtgacatgggatgtgactttcgggtgtcggggcagcatgcccttctcccccacttccttactttagcgggctgcaatgccgccgatatgatggctgggagctctggcagccatacggcaccatgaagtagcggcaatgtttgagcggcacaataagataggaagagtctggatctctgatgatcacagagccatcctaacaaacggaatatcacccgacctcctttatgtgagagagaaataaacatcttatgtaaaatacca

SEQ ID NO: 23132 - DNA, 1706 bp, Homo sapiens
attccccaacactcctcctccccggcgaaaccgggcaccagcaggcgtttgcgagaggagatacgagctggacgcctggcccttccctcccaccgggtcctagtccaccgctcccggcgccggctccccgcctctcccgctatgtaccgaccgcgagcccgggcggctcccgagggcagggtccggggctgcgcggtgcccagcaccgtgctcctgctgctcgcctacctggcttacctggcgctgggcaccggcgtgttctggacgctggagggccgcgcggcgcaggactccagccgcagcttccagcgcgacaagtgggagctgttgcagaacttcacgtgtctggaccgcccggcgctggactcgctgatccgggatgtcgtccaagcatacaaaaacggagccagcctcctcagcaacaccaccagcatggggcgctgggagctcgtgggctccttcttcttttctgtgtccaccatcaccaccattggctatggcaacctgagccccaacacgatggctgcccgcctcttctgcatcttctttgcccttgtggggatcccactcaacctcgtggtgctcaaccgactggggcatctcatgcagcagggagtaaaccactgggccagcaggctggggggcacctggcaggatcctgacaaggcgcggtggctggcgggctctggcgccctcctctcgggcctcctgctcttcctgctgctgccaccgctgctcttctcccacatggagggctggagctacacagagggcttctacttcgccttcatcaccctcagcaccgtgggcttcggcgactacgtgattgcaagctgcctcatttcagatacgagaaaaccaaacagagactggcaaacactagagcggacatcgaaatcctctgggggcttgttaaaatacagatttctggccgggcacggtggctcacacctgtaattctaacactttgggaggccgaggaatgaacccctcccagaggtacccactgtggtacaagaacatggtgtccctgtggatcctctttgggatggcatggctggccttgatcatcaaactcatcctctcccagctggagacgccagggagggtatgttcctgctgccaccacagctctaaggaagacttcaagtcccaaagctggagacagggacctgaccgggagccagagtcccactccccacagcaaggatgctatccagagggacccatgggaatcatacagcatctggaaccttctgctcacgctgcaggctgtggcaaggacagctagttatactccattctttggtcgtcgtcctcggtagcaagacccctgattttaagctttgcacatgtccacccaaactaaagactacattttccatccaccctagaggctgggtgcagctatatgattaattctgcccaatagggtatacagagacatgtcctgggtgacatgggatgtgactttcgggtgtcggggcagcatgcccttctcccccacttccttactttagcgggctgcaatgccgccgatatgatggctgggagctctggcagccatacggcaccatgaagtagcggcaatgtttgagcggcacaataagataggaagagtctggatctctgatgatcacagagccatcctaacaaacggaatatcacccgacctcctttatgtgagagagaaataaacatcttat

SEQ ID NO: 23133 - DNA, 1155 bp, Homo sapiens
atggaggtctcggggcacccccaggccaggagatgctgcccagaggccctgggaaagctcttccctggcctctgcttcctctgctttctggtgacctacgccctggtgggtgctgtggtcttctctgccattgaggacggccaggtcctggtggcagcagatgatggagagtttgagaagttcttggaggagctctgcagaatcttgaactgcagtgaaacagtggtggaagacagaaaacaggatctccaggggcatctgcagaaggtgaagcctcagtggtttaacaggaccacacactggtccttcctgagctcgctctttttctgctgcacggtgttcagcaccgtgggctatggctacatctaccccgtcaccaggcttggcaagtacttgtgcatgctctatgctctctttggtatccccctgatgttcctcgttctcacggacacaggcgacatcctggcaaccatcttatctacatcttataatcggttccgaaaattccctttctttacccgccccctcctctccaagtggtgccccaaatctctcttcaagaaaaaaccggaccccaagcccgcagatgaagctgtccctcagatcatcatcagtgctgaagagcttccaggccccaaacttggcacatgtccttcacgcccaagctgcagcatggagctgtttgagagatctcatgcgctagagaaacagaacacactgcaactgcccccacaagccatggagaggagtaactcgtgtcccgaactggtgttgggaagactctcatactccatcatcagcaacctggatgaagttggacagcaggtggagaggttggacatccccctccccatcattgcccttattgtttttgcctacatttcctgtgcagctgccatcctccccttctgggagacacagttggatttcgagaatgccttctatttctgctttgtcacactcaccaccattgggtttggggatactgttttagaacaccctaacttcttcctgttcttctccatttatatcatcgttggaatggagattgtgttcattgctttcaagttggtgcaaaacaggctgattgacatatacaaaaatgttatgctattctttgcaaaagggaagttttaccaccttgttaaaaagtga

SEQ ID NO: 23134 - DNA, 2496 bp, Homo sapiens
aagaaaccttggaggaagaacggcattaaagatcaaaagcatgatgactcctgatgaaaacatcaccaaatgatgaacccacgagcaaaaagggatttctacttggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcaggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctctttccctaatgtgccataaggcctcagaatgaatgagaattgtttctggtaacaatgtagctttgagggatcagttcttaacttttcagggtctacctaactgagcctagatatggaccatttatggatgacaacaattttttttttgtaaatgacaagaaattcttatgcagccttttacctaagaaattttctgtcagtgccttatcttatgaagaaacagaacctctctagctaatgtgtggtttctccttccctgcccccacccctaggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaatgcagaaagaaaataatttccctaaatataattgcaaactgatttcttttacttttttgtgtgtgggggtgggagctgtatctgaataagtggcattcagattagggtcttgaaaaataaacccagaatctttaaaagaagcaaataaactaatagacgcttattttccaaaatttaaatttaagctagaaatgtaaatattcaattaatttgttaaaagtacttttataaagttaaaaaaaatccaaccaaaattttagaaagtcaggctcttttagaaagaaagctacacccatttcctcaaataactgttccgaaaatttatatggtggaatgcgccatgtataaactgtgaattgtattgacaaataaagtttgtaattaaagtc

SEQ ID NO: 23135 - DNA, 1491 bp, Homo sapiens
ggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaatggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggt

SEQ ID NO: 23136 - DNA, 1410 bp, Homo sapiens
gaaaccttggaggaagaacggcattaaagatcaaaagcatgatgactcctgatgaaaacatcaccaaatgatgaacccacgagcaaaaagggatttctacttggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtag

SEQ ID NO: 23137 - DNA, 3379 bp, Homo sapiens
ccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttctctatgctctttatgactgttgctggtagcattttttaaattgtgcatgagctcaaagggggaacaaaatagatacacccatcatggtcatctatcatcaagagaatttggaattctgagccagcactttctttctgatgatgcttgttgaacggtccactttctttgatgagtggaatgacaagcaatgtctgatgcctttttgtgcccagactgttttcctctctctttccctaatgtgccataaggcctcagaatgaatgagaattgtttctggtaacaatgtagctttgagggatcagttcttaacttttcagggtctacctaactgagcctagatatggaccatttatggatgacaacaattttttttttgtaaatgacaagaaattcttatgcagccttttacctaagaaattttctgtcagtgccttatcttatgaagaaacagaacctctctagctaatgtgtggtttctccttccctgcccccacccctaggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaaaatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagcttctaattgctttttgatgtatgaaaggcttatataattttcttttcgttgggtgacttttgccagatgagaggaggtggcacagtggtgagtgcagggcacagtcctagccttctgtgggtatacttttggagttgtgacttggctgtgagggcagaagttgaagttgggatcactgtgactttgcacatggaaaaatgcagattgcaggcataattcatctctgacattagagaaaaagctgttatagcacaatttaaattttgagagtttgctgtgtttttttttcacataaaagaggctgattattctttttagtttaattttatatcctgtaattctttggatggttccaagattcagaaaaaattcagtaaatgcaccccgtaaattgctaccctttcctttattttcatacttagatctgctgtacattgtatatatatataatttttaaaatgcagaaagaaaataatttccctaaatataattgcaaactgatttcttttacttttttgtgtgtgggggtgggagctgtatctgaataagtggcattcagattagggtcttgaaaaataaacccagaatctttaaaagaagcaaataaactaatagacgcttattttccaaaatttaaatttaagctagaaatgtaaatattcaattaatttgttaaaagtacttttataaagttaaaaaaaatccaaccaaaattttagaaagtcaggctcttttagaaagaaagctacacccatttcctcaaataactgttccgaaaatttatatggtggaatgcgccatgtataaactgtgaattgtattgacaaataaagtttgtaattaaagtcagca

SEQ ID NO: 23138 - DNA, 1200 bp, Homo sapiens
gacaagaaaccttggaggaagaacggcattaaagatcaaaagcatgatgactcctgatgaaaacatcaccaaatgatgaacccacgagcaaaaagggatttctacttggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcagcaaatagtggcagcaataaatgcagggattataccgttaggaaacacctccaatcaaatcagtcactgggatttgggaagttccttcttctttgctggcactgttattacaaccataggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattgtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggtgaggacttct

SEQ ID NO: 23139 - DNA, 961 bp, Homo sapiens
accttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggagtggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcaggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagatt

SEQ ID NO: 23140 - DNA, 1883 bp, Homo sapiens
aacattcacacacaaaaaggaaacagtatgggacgatggcttgttagtacaagtgactctgttttggaaattacggacaagaaaccttggaggaagaacggcattaaagatcaaaagcatgatgactcctgatgaaaacatcaccaaatgatgaacccacgagcaaaaagggatttctacttggcggcacctgacttgctggatcctaaatctgccgctcagaactccaaaccgaggctctcgttttccacgaaacccacagtgcttgcttcccgggtggagagtgacacgaccattaatgttatgaaatggaagacggtctccacgatattcctggtggttgtcctctatctgatcatcggagccaccgtgttcaaagcattggagcagcctcatgagatttcacagaggaccaccattgtgatccagaagcaaacattcatatcccaacattcctgtgtcaattcgacggagctggatgaactcattcaggatttggaaacatctcaccacgcacagaaggcggcaaaatattctgtatcatctatgccttactgggaattcccctctttggttttctcttggctggagttggagatcagctaggcaccatatttggaaaaggaattgccaaagtggaagatacgtttattaagtggaatgttagtcagaccaagattcgcatcatctcaacaatcatatttatactatttggctgtgtactctttgtggctctgcctgcgatcatattcaaacacatagaaggctggagtgccctggacgccatttattttgtggttatcactctaacaactattggatttggtgactacgttgcaggtggatccgatattgaatatctggacttctataagcctgtcgtgtggttctggatccttgtagggcttgcttactttgctgctgtcctgagcatgattggagattggctccgagtgatatctaaaaagacaaaagaagaggtgggagagttcagagcacacgctgctgagtggacagccaacgtcacagccgaattcaaagaaaccaggaggcgactgagtgtggagatttatgacaagttccagcgggccacctccatcaagcggaagctctcggcagaactggctggaaaccacaatcaggagctgactccttgtaggaggaccctgtcagtgaaccacctgaccagcgagagggatgtcttgcctcccttactgaagactgagagtatctatctgaatggtttgacgccacactgtgctggtgaagagattgctgtgattgagaacatcaaatagccctctctttaaataaccttaggcatagccataggctcacctctgcagtcttttaccccagttctcccatttgaataccataccttgctggaaacagtgtgtaaaatgactgaagtgatgatgcccgaagatgaaatagatgccaaattagatggacattgaagcaacactcagcgttgcctagcgttaaaggcactgcagagaaatgaggtgcagaggtggcccctctgagtatttatttgactcaggtaccagtggtacatatatacagtgtaattatgaccaggctggtaaaattggctgctcgcaaacaatccccttttttcctggcagtatttggaatttatcatttattaataactatacatttttaaaggcagaagaagaaaatctatctatctatctatctatctatctatctatctatctatctatctatctaaatgacctgacagaagaaaactgttaaaaatggatattattggaggggatttaaaacagtgggtgtgaattatcattctgatggaaagaaaatagcaaaacaatgtgttacaagtatttgctaataaacagtatactgccagc

SEQ ID NO: 23141 - DNA, 6162 bp, Homo sapiens
tgcccggcgcggagagcggcgagcgcagccatgccccaggccgcctccggggcagcagcagcggcggccggggccgaggcgcgggccgggggcgccggggggccggcggcggcccgggcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgaggggcctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttcaagctaactggcctccagccacattctcatagcaggtaggacttcagccttccagacactgcccttagaatctggaacagaagacttcagactcaccataattgctgataattacccactcttaaatttgtcgagtgatttttagcctctgaaaactctatgctggccactgattcctttgagtctcacaaaaccctacttaggtcatcagggcaggagttctcactcccattttacagatgagaatactgaggcctggacaggtgaagtgaccagagagcaaaaggcaaaggggtgggggctgggtgcagtggctcacacctgtattcccaacacttttggaggctgaggttggaggattgcttgagcccaggaatttgagaccagcctaggtgacatagtgagaccccatctctacaaaaaataaaaaattaaccaggtgtggtggcacgtgcctgggagtcccagcgacttgggaggctgaggtgggaggattgtttgagcctgggaggtcgaggctgtagtgagccctgattgcaccactgtactccagcctgggtgacagggcaagaccctgtctcaaaaaaaaaaaaaaaaatggcaaagggagacaagagcccagcctgcttgttgctagccaaagtgttctttccttccagcttggcctgctcttaaaagcaaagctcctgcagtgtacatcctggcattgtgtggctacctgggttttaaaccagaatcagaagtcccggatcagagggcactgctgaggttcagcctcttctcttcttggccaggaggcagcagctctgaatgggcccctgaggctgcacaggggcctttgtcactggggcgcatgcttacaaacagtgcagttcttgggaccgaggtaagcagggctgggtctcatggcagaaaggccaggatctggggctctaggaatttgggaattgggcagagtggccaagaaagctggcaggcatatcctatgggacatcacacctggcaccattgtcattgttggtgcctgtgtcccaagtagctagtgataagctgaggctgcagcaagaaacacccttcccaggtgggggagtttggaccagaggtgccctctgcccaccacacctgcaacccagaagcccagatggaacgcagctgacgaaggtgatgcttgaggctcacttttggggccccacagctggagccggtataatgactgggacaacatcaaggggtggatgaggggcctctcctcccgcaacactgccttcccatgctgttcccctgccagctccttaacactgccgaccaaggccagccctggcattcagggaaattggagggcagcacccgtagggtggccagcctcaggccccaccccagctgtgtcctctagtctctggggacccctggggggaagaagtctaccctgcttgtgagtcccgtctcagtgtggaggaactggctgcacgtgggacctgaaggtgccctctgtgtttatgttgggggtgggggggcagtgctggctgcctctgtcctgtgtgtgaccctgccctcgaagggtcctgtcctgtcagtcccgagggagccacaaccaaagctgcggagagaaggtggggaagggtgcagaatggccgtggggcacagcgtggcagactgttcagtctctgctgggtctttcctagggacctggaaggccagtgttgcttccccctcactccctttcactgcaggcagcctctctgcttccccaatgccttatgcctgggcacactgccacagaatatgcaatatgtgtgggtgaccatgccctcacgaccacacccccaccccgggcagcccccggactccaaaggtcgtggctgccacagcctccctcagctcttcctgcctatctgtcttcacactgagaatggcgcccaataaatgctatccacggagaccaggctcaggctccagctgcctctgtcatcgtatgcccttgctgctgccagggaggggccatctcccaccccctcccctgccggggtctacaaacatatctagctgctgggtgccgtggctcacacctatagtcacagcactaggcgggcagatcacctgaggtcagaagttcaagaccagcctggccaacatggtaaaaccccgtctctactaaaaatacaaaaattagctgagcgtggtggcgcatgtctgtagtcccagctactcggctactcaggaggctgacgcacgagaatcgcttgaacccgggaggcggaggttgcagtgagctgagatcgtgccactgcactccagcctgagcgacagagtgagaccctgtctaaaaaaaaacaataataataaaataaaataacatacctagctgactcgccatgggctcgctggcctgtgggcgacactggcttcccttttgggatttcccagaagatccagattttcttaagtccccttggaacagactaagaaaggatcaccttagaaatcacctggtcctattgtcccccccgtacatgagtaactgaggcccacagagagcaaatcgcctgcctgagtcacacagcagtgagtggcagacctaggctaggaactaggactggggattgctattccagtgctccccatcctcacacagactgcacagtccgcctggacacaccccagctgacagtggtacctcccagtcagccaggagaatggattccttctcctgcagtaggggccccctggctgagtggcctgattgactaaaacatatgtctttgaaggagagtgcatcacaagcacctttctttggggtagatttttctctgggtctagagggacagctcaggcttgggactgggcctcagaacctacgacagaccgtgagagcagacccaccttatccatctggtgccagctccccaggtcagctacagcgacccccggacttcatagagtacaatccacagtaatagcacacagctctgtacctatctagctccatgcctatctatctgcctacctttcacaaaataattcttagcaaccctgctacagccaatgattctaatacgttctgttctattgcatgttataaaatgctggtcacgatccactaaattgatgtctctacctgctaatggtttaatacctgcagattgaaatatactggagaaataaagagagtgggagtagggacactttctcccagtgcccacaccgcccctcgttacccgcataggtcaactgaaagatacagagagggaagctttgatggggggttcagagttcaaaggaagaaatgatggcacctgcactccctgcccccagaggcaggacacagccagccctcctgtgacagcactcctggcagctccttgttggcctgcagccctcagggggcttagttgccattgactcacccactcctaaggccaccacatcaaaatctgaggcttactgccctgtcccacctgcctctgtctttcttaaaacagctaaatgcaacaatagcagaaattagcttgtttttgaggttggcaatgaccagttcaaggtgactcttattttcttaagcagtgcttgcaggacataaatgtgatgacacttgccctcctttctttatcgcctgggacagactttacaaacagacctgggagaagtcccctaaggggctgcatttatccccatctccctaggggtgatcagcattgtgacagctgggcagagcagtggtgaactgcacccatgtccctgctcacatctcctaagatctcagaattgcctgaggttctagcgtgggctccttctctccagatgatgccatccccacccccctcatttccacacagcatctgaggcatcctgcactaaaagatatatgtacagcaaaacaaaaatagaaaaccagcacagcagagtggaggtggggtataaatatacccagatccccgctgatttggttactcggggtgagcatcagatggaaatagaagtttccgggggccaagagagaaagagggatgtaacgacaattcttttcaaaacgtgtcccatggtatgcctcgtggaaaaaatggttcgttggtcaaatgaatttgggaaaatgctgtcaatatcaccgactcatggagcttcgcaaggcatcttagcttaataaaggttatgaaaagtcttgcagcaaa

SEQ ID NO: 23142 - DNA, 1956 bp, Homo sapiens
tggtgctgaagggacagctccgcggcggcggcggcggcggcggccccgggcgctgagcgggtgcccggcgcggagagcgggacgatgaagcggcagaacgtgcgcacgctggcgctcatcgtgtgcaccttcacctacctgctggtgggcgccgcggtcttcgacgcgctggagtcggagcccgagctgatcgagcggcagcggctggagctgcggcagcaggagctgcgggcgcgctacaacctcagccagggcggctacgaggagctggagcgcgtcgtgctgcgcctcaagccgcacaaggccggcgtgcagtggcgcttcgccggctccttctacttcgccatcaccgtcatcaccaccatcggctacgggcacgcggcacccagcacggatggcggcaaggtgttctgcatgttctacgcgctgctgggcatcccgctcacgctcgtcatgttccagagcctgggcgagcgcatcaacaccttggtgaggtacctgctgcaccgcgccaagaaggggctgggcatgcggcgcgccgacgtgtccatggccaacatggtgctcatcggcttcttctcgtgcatcagcacgctgtgcatcggcgccgccgccttctcccactacgagcactggaccttcttccaggcctactactactgcttcatcaccctcaccaccatcggcttcggcgactacgtggcgctgcagaaggaccaggccctgcagacgcagccgcagtacgtggccttcagcttcgtctacatccttacgggcctcacggtcatcggcgccttcctcaacctcgtggtgctgcgcttcatgaccatgaacgccgaggacgagaagcgcgacgccgagcaccgcgcgctgctcacgcgcaacgggcaggcgggcggcggcggagggggtggcagcgcgcacactacggacaccgcctcatccacggcggcagcgggcggcggcggcttccgcaacgtctacgcggaggtgctgcacttccagtccatgtgctcgtgcctgtggtacaagagccgcgagaagctgcagtactccatccccatgatcatcccgcgggacctctccacgtccgacacgtgcgtggagcagagccactcgtcgccgggagggggcggccgctacagcgacacgccctcgcgacgctgcctgtgcagcggggcgccacgctccgccatcagctcggtgtccacgggtctgcacagcctgtccaccttccgcggcctcatgaagcgcaggagctccgtgtgactgccccgaggggcctggagcacctgggggcgcgggcgggggacccctgctgggaggccaggagactgcccctgctgccttctgcccagtgggaccccgcacaacatccctcaccactctcccccagcacccccatctccgactgtgcctgcttgcaccagccggcaggaggccgggctctgaggacccctggggcccccatcggagccctgcaaattccgagaaatgtgaaacttggtggggtcagggaggaaaggcagaagctgggagcctcccttccctttgaaaatctaagaagctcccagtcctcagagaccctgctggtacccagacccccaccttcggaggggacttcatgttccgtgtacgtttgcatctctatttatacctctgtcctgctaggtctcccaccttcccttggttccaaaagccagggtgtctatgtccaagtcacccctactcagccccactccccttcctcatccccagctgtgtctcccaacctcccttcgtgttgttttgcatggctttgcagttatggagaaagtggaaacccagcagtccctaaagctggtccccagaaagcaggacagaaagaaggagggacaggcaggcagcaggaggggcgagctgggaggcaggaggcagcggcctgtcagtctgcagaatggtcgcactggaggttca

SEQ ID NO: 23143 - DNA, 1673 bp, Homo sapiens
gtgcacgctagtgtccacacacgtgtgcgtgggctctgggtgccctggcgcggccggcacgcccatgggggccggggatgccggggcgtctgcggagagtgcaggtgggtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccgga

SEQ ID NO: 23144 - DNA, 1697 bp, Homo sapiens
agagacgggccagctgatgcccaggtcggggccctgccgctggccacactgggctccggtccaaggctagaaggctggcccctgctgcaacccctctccggctcctctgccacccacctcccggggctggccggctgtggggagccaggcggccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgca

SEQ ID NO: 23145 - DNA, 1723 bp, Homo sapiens
caggcttaggctctctttcggcctcccactcgccttcctttcccttctcggtgccctcctctctttcctcacccggtagtcccagacaggggctgagggccgggcagcggaggtaaggggaaggctggagataggagggggactgggtgtgtccagccagagggatgtctgtggacagtgcagctgggggctttatggatctttgggtgtgtaggggatagaggaggagggtgtgggtgtcaggccagctcagtgaccccagcatccctggttttgcccgcagtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccc

SEQ ID NO: 23146 - DNA, 2733 bp, Homo sapiens
cagtcggcaccggcgaggccgtgctggaacccgggcctcagccgcagccgcagcggggccgacatgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccaggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatg

SEQ ID NO: 23147 - DNA, 2778 bp, Homo sapiens
gtgcacgctagtgtccacacacgtgtgcgtgggctctgggtgccctggcgcggccggcacgcccatgggggccggggatgccggggcgtctgcggagagtgcaggtgggtgacgacagctccccaggagccccccgcccggcccctccaggcgggcagtggagctggcccggcgcctgggcgcgccatgcgcagcaccacgctcctggccctgctggcgctggtcttgctttacttggtgtctggtgccctggtgttccgggccctggagcagccccacgagcagcaggcccagagggagctgggggaggtccgagagaagttcctgagggcccatccgtgtgtgagcgaccaggagctgggcctcctcatcaaggaggtggctgatgccctgggagggggtgcggacccagaaaccaactcgaccagcaacagcagccactcagcctgggacctgggcagcgccttctttttctcagggaccatcatcaccaccatcggctatggcaatgtggccctgcgcacagatgccgggcgcctcttctgcatcttttatgcgctggtggggattccgctgtttgggatcctactggcaggggtcggggaccggctgggctcctccctgcgccatggcatcggtcacattgaagccatcttcttgaagtggcacgtgccaccggagctagtaagagtgctgtcggcgatgcttttcctgctgatcggctgcctgctctttgtcctcacgcccacgttcgtgttctgctatatggaggactggagcaagctggaggccatctactttgtcatagtgacgcttaccaccgtgggctttggcgactatgtggccggcgcggaccccaggcaggactccccggcctatcagccgctggtgtggttctggatcctgctcggcctggcttacttcgcctcagtgctcaccaccatcgggaactggctgcgagtagtgtcccgccgcactcgggcagagatgggcggcctcacggctcaggctgccagctggactggcacggtgacagcgcgcgtgacccagcgagccgggcccgccgccccgccgccggagaaggagcagccactgctgcctccaccgccctgtccagcgcagccgctgggcaggccccgatccccttcgccccccgagaaggctcagccgccttccccgcccacggcctcggccctggattatcccagcgagaacctggccttcatcgacgagtcctcggatacgcagagcgagcgcggctgcccgctgccccgcgcgccgagaggtcgccgccgcccaaatccccccaggaagcccgtgcggccccgcggccccgggcgtccccgagacaaaggcgtgccggtgtaggggcaggatccctggccgggcctctcaagggcttcgtttctgctctccccggcatgcctggcttgtttgaccaaagagccctctttccacgagactgaagtctggggaggaggctacagttgcctctccgcctcctccctggccccggcccttccctcacttccatccatctctagacccccccaaggctttctgtgtcgctgccccgggcgggtgtatccctcacagcacctcacgactgtgcctcaaagcctgcatcaataaatgaaaacggtctgcaccgctgcgggcgtgacgctcccggacgcgagtgggtgtggaattgctttcctcgggccaccgtgggggcacctctggcctcccgtgacccccaggccgagggtccccgggcacccaggtcggtcaagtctcggccctctcaggcccgcgtctctgcctggaggagactgtgtagggtccggcgtggggatcagccaggatgggctgcgcgtctccagcctctgcacacacattggcgggtggggtgcagggagggagaggcaggggagagagaatggcatctcgcgtggagggctgtcgtttgaactctcccagcgcgagagaccctgccccgcccccttcctggagcgttgactcccttctcgtctcgaggcctgtggcgtctgggtccgttggggcagaaccatggaggaaaagccttcgaaagtgtcgctcaagtcttccgaccgccaaggctcggacgaggagagcgtgcatagcgacactcgggacctgtggaccacgaccacgctgtcccaggcacagctgaacatgccgctgtccgaggtctgcgagggcttcgacgaggagggccgcaacattagcaagacccgcgggtggcacagcccggggcggggctcgttggacgaggggtacaaggccagccacaagccggaggaactggacgagcacgcgctggtggagctggagttgcaccgcggcagctccatggaaatcaatctgggggagaaggacactgcatcccagatcgaggccgaaaagtcttcctcaatgtcatcactcaatattgcgaagcacatgccccatcgagcctactgggcagagcagcagagcaggctgccactgcccctgatggaactcatggagaatgaagctctggaaatcctcaccaaagccctccggagctaccagttagggatcggcagggaccacttcctgactaaggagctgcagcgatacatcgaagggctcaagaagcgccggagcaagaggctgtacgtgaattaaaaacgccaccttgggctcgagcagcgacccgaaccagccccgtgccagcccggtccccagacccaagcctgaccccatccgagtggaatttgagtcctaaagaaataaaagagtcgatgcatg

SEQ ID NO: 23148 - DNA, 3756 bp, Homo sapiens
agcgacgcgtggagaagcggcccacgtgtctgcccagagtcaagtcctgtgttcttcccgctccttacgcatccgcggtccagggcgccctttcagccccgctggtgttcgcccaccccgggccgcgtgagtggggccccacgcagctccccgcactccgtgggccaacttggccaagcaactctgtccggggagcggtgcttgcggggggtgagtaccgggcactgcgcatgcggagctccaaattcaaacagctgttttcagaggctggagggcgggcggactggtagcagctggggctaggagaggctttctctaggaggcggccgctcgggagccatggtggaccggggccctctgctcacctcggccatcatcttctacctggccatcggggcggcgatcttcgaagtgctggaggagccacactggaaggaggccaagaaaaactactacacacagaagctgcatctgctcaaggagttcccgtgcctgggtcaggagggcctggacaagatcctagaggtggtatctgatgctgcaggacagggtgtggccatcacagggaaccagaccttcaacaactggaactggcccaatgcaatgatttttgcagcgaccgtcattaccaccattggatatggcaatgtggctcccaagacccccgccggtcgcctcttctgtgttttctatggtctcttcggggtgccgctctgcctgacgtggatcagtgccctgggcaagttcttcgggggacgtgccaagagactagggcagttccttaccaagagaggtgtgagtctgcggaaggcgcagatcacgtgcacagtcatcttcatcgtgtggggcgtcctagtccacctggtgatcccacccttcgtattcatggtgactgaggggtggaactacatcgagggcctctactactccttcatcaccatctccaccatcggcttcggtgactttgtggccggtgtgaaccccagcgccaactaccacgccctgtaccgctacttcgtggagctctggatctacttggggctggcctggctgtccctttttgtcaactggaaggtgagcatgtttgtggaagtccacaaagccattaagaagcggcggcggcgacggaaggagtcctttgagagctccccacactcccggaaggccctgcaggtgaaggggagcacagcctccaaggacgtcaacatcttcagctttctttccaagaaggaagagacctacaacgacctcatcaagcagatcgggaagaaggccatgaagacaagcgggggtggggagacgggcccgggcccagggctggggcctcaaggcggtgggctcccagcactgcccccttccctggtgcccctggtagtctactccaagaaccgggtgcccaccttggaagaggtgtcacagacactgaggagcaaaggccacgtatcaaggtccccagatgaggaggctgtggcacgggcccctgaagacagctcccctgcccccgaggtgttcatgaaccagctggaccgcatcagcgaggaatgcgagccatgggacgcccaggactaccacccactcatcttccaggacgccagcatcaccttcgtgaacacggaggctggcctctcagacgaggagacctccaagtcctcgctagaggacaacttggcaggggaggagagcccccagcagggggctgaagccaaggcgcccctgaacatgggcgagttcccctcctcctccgagtccaccttcaccagcactgagtctgagctctctgtgccttacgaacagctgatgaatgagtacaacaaggctaacagccccaagggcacatgaggcagggccggctccccaccccacctttgatggcctcttcccccctcaccctagggtgtcccgagatgaccgggacgcctggcccctggtgggggggcagcctcggaactgggagtggggggccaggggccttcctaaccttccatcatcctcagctagatgtatgcccgggacagggcctctgttctccagctgaaccataccctggctgtgggggcatctgtcctgagcttggctggtgtatctcacaatgcaaagacatgctggctggcgggacaggtgggcaggactgaccctgaggaggccttgcctgcagggtctttgtctcaccatttggtggagtatcacacggttctctgaggtctggggcctcagctgtttaagtttaccggtattactgagctcggcatttggagagggagctctgaagtgtctggggaggtaccgctgtgcgtggggtcaggtgtttccgtaccacagcaggagcagggcccgcccgcatcccagctgtgggcctgccggtcaggtcgggcacctactacaaaccgtagtggggtggaggctgctggaggtgggagtgaggagatgagggcagggtctcaaacagtcctgactcacagggcctggaaacaagtcctatgtgggcctggggcctggggtcctcatcctccttgttggtctactcaggcccagcccagagctgtgttccctgtctcaggtcaagcagtggcagacgcaaggctttctgtgggcccccaagtggtaggagggagagtagcagagcatgggttactggaagccgggactgctagggctggtggccagggagctgcaagagtgaggctcagctctggctggttctgcccttacccctcctgcccgcctgagaactgcacaccctgcccgctggccccaggacctgcactcccaatcctgctgtcttctccttccctgtgccctgaacaaggacctcactgcccgccttcccctcccaccagcccccttgggccaggcagggtgaggccaaattgctcttggcccacaaatgggtgatggtcagatatgtgaatcaagctcctttctctagctagtgtttgatgtgcacgtgtgtgtgcacagtgcgtgtgtgcacacgcacacctgtgcactcgtgtgtgtttaagaaaggaaaggatttgggctggggagcaaaagataatgtgaaactgttggtggactctctggtgaggggtgggcagaacttgctgctactagagttcttgggttctccatgatgttcaccctggggctggcccactgtgtcctgaatgtttttgttattttttgttttattttttaaacaaactgctgtttttatatacctggaatctgttgttggcttcagagccagtggttaaagagcagggtcccaaggattgggagatctagtgtctgccctcctgccctgcaactcaattgggcctttttcggtgacctcatccaaggccatgatgtcaagggccatgtccccaagcagaggtggagaaggggacactgaggtgagcaaaagcaggaaggggcatccactgcgggtgactggaggccgggcaggaagcaagtcatcagagccgctcagctccgttcactctctgccttctgccccactactgtggggcagtggggccagagcccacctccccaacatgtgaagacagtgatgggcacgtgcccacacccccacttctctagccgtttgcagaggccgccacccagcaggggcctgaaaaggagcagcctcgtatttttctgtgaaatgttttaatgaaccatgttgttgctggttgtcctggcatcgcgcacactgtatgtacatactggcaacgatgtcaaatgtaatttattttaacatttttacaataaaacatgaggtggacaggc

SEQ ID NO: 23149 - DNA, 2648 bp, Homo sapiens
gctgccgcgcctgtagcactcccggaactggaactaggtgccagacggtccggaggcgggggccacgtcagcggggccacccagggctcgcggggtcccggtgggtgccatgcggaggggcgcgcttctggcgggcgccttggccgcgtacgccgcgtacctggtgctgggcgcgctgttggtggcgcggctggaggggccgcacgaagccaggctccgagccgagctggagacgctgcgggcgcagctgcttcagcgcagcccgtgtgtggctgcccccgccctggacgccttcgtggagcgagtgctggcggccggacggctggggcgggtcgtgcttgctaacgcttcggggtccgccaacgcctcggaccccgcctgggacttcgcctctgctctcttcttcgccagcacgctgatcaccaccgtgggctatgggtacacaacgccactgactgatgcgggcaaggccttctccatcgcctttgcgctcctgggcgtgccgaccaccatgctgctgctgaccgcctcagcccagcgcctgtcactgctgctgactcacgtgcccctgtcttggctgagcatgcgttggggctgggacccccggcgggcggcctgctggcacttggtggccctgttgggggtcgtagtgaccgtctgctttctggtgccggctgtgatctttgcccacctcgaggaggcctggagcttcttggatgccttctacttctgctttatctctctgtccaccatcggcctgggcgactacgtgcccggggaggcccctggccagccctaccgggccctctacaaggtgctggtcacagtctacctcttcctgggcctggtggccatggtgctggtgctgcagaccttccgccacgtgtccgacctccacggcctcacggagctcatcctgctgccccctccgtgccctgccagtttcaatgcggatgaggacgatcgggtggacatcctgggcccccagccggagtcgcaccagcaactctctgccagctcccacaccgactacgcttccatccccaggtagctggggcagcctctgccaggcttgggtgtgcctggcctgggactgaggggtccaggcgaccagagctggctgtacaggaatgtccacgagcacagcaggtgatcttgaggccttgccgtccaccgtctctcctttgtttcccagcatctggctgggatgtgaagggcagcactccctgtccccatgtcccgggctccactgggcaccaacataaccttgttctctgtcctttctctcatcctctttacactgtgtctctctggctctctggcattctcgctgcctctgtctttccctcttgctgtctctgtttctcattctctttcatgttccgtctgtgtctctcaattaaccactcgtcaactgctgattctactgggctgtgggctcagacctcatttcaggcaccagattggtcgctacaccctggacaagtgactgcccgtctctgagccttgatttcctcagctgccaaatgggaagaatagaagaatttgcccctaaacccctcctgtgtgctggccctgtgctagacagtgctggagacatagttgggggtggagaactgcccttatggagcttgcagtccagtgaggtggacagacctgtccccagacagtgatggcccaaaatggtcaggactttaatggaggaggtgaggtgttgaaagcacaggcagagtggtcagggctgaagtcggagaagcatagggactaggcccaatccagcctggaaagtcagggaggacttcctagaggaagggacatcgaactaagacctgaactatgagaaataggcaggaagaagttgtacctgactcatttttctcaggtgtctccagggagcaggacccatggagggacccctggtgtaggcctgggcgatagactcttcctcagcagcctggcaggcaggaaacagacataggaccccagcccagatctgaatggcatgggaggtgctgcccttaaccatgacaccattgtaagagctgtccacatttgtatgttgtgccctggaatcagcctggttgagctcaaatcccaacttagccacgtctggcctgtgtccttgggcagtcacactacctctctgattttgtttccttatctgtaaaatggtgatcatcataatacaacttcaaaaggatttcaggctgagtgtggtggctcacgcctatacacccagcactttggaaggctgaggaaggaggatcgcttgaggccaggagtttgagactagcctaggcaacacagtgaggccttatctcaacaacaaccacaaaatctaaaaattagctgggtgtggtggtgcatgcctgtgatcctggctacttcagaggctgaggtggaaggatcacttgaggccaggagtttgaggctgcagtgagttatgatggcactgctgcactccagcctgcgggacagagtgagaccctgtctgaaagaaagagagaaagaaagaaagaaagagagagaaagaaagaaagaaagaaagggaaagatggaaggaaggaaggaaaaagaaagagaaagagagagagagagaaagaaaaagaaagaaaagtaagaaagaaaaaagaaaaagaaagaaaagt

SEQ ID NO: 23150 - DNA, 1298 bp, Homo sapiens
atccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcataaaatgagcaacga

SEQ ID NO: 23151 - DNA, 1283 bp, Homo sapiens
gagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtggagggacctcactccagggcacggcgtgggaggggtagtcgaagagctctggtggcagcgttgagaagggggtgagtggtgccagttgccagggcaagtcactgcgctgggaggtgggcggggagcatcaccagaacccaggcgctgccccagcaccttctcctccccaggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcataaaatgagcaacga

SEQ ID NO: 23152 - DNA, 1563 bp, Homo sapiens
atccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtaagtccagccacctaacagcgtgtgggggaagggggaagaggagcctggactaggactcccataaatcactggggggctgggccttgcaggtggagggacctcactccagggcacggcgtgggaggggtagtcgaagagctctggtggcagcgttgagaagggggtgagtggtgccagttgccagggcaagtcactgcgctgggaggtgggcggggagcatcaccagaacccaggcgctgccccagcaccttctcctccccaggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcataaaatgagcaacga

SEQ ID NO: 23153 - DNA, 1372 bp, Homo sapiens
atccccaccatcccagctgctgtgaaatgggcaaatgtcttgcctccaggacctgggaagggtgatgcagctcacctccctcctgttcacaccccagccaccccagccatcccagccgggtcccagccacccacacagcacctcctcctggccccgccctgcccagcccctcccaggtgcctgaggtggagccgccagttcccacagcaccccagcggcctgccatggggggtctaaggccctggtcccgatacgggctcctggttgtggcccacttgctggccctggggcttggggctgtggtgttccaggccctggaggggcctcctgcatgcaggcttcaggctgagctcagggcagagctggcagccttccaggcagagcatagggcctgcctgccacccggagctctggaagagctgctgggcactgccctggccacccaggcccatggggtctccaccctgggcaacagctcagagggcaggacctgggaccttccctcagccctgctcttcgctgccagcatcctcaccaccacaggttatggccacatggccccactatcgccaggcggaaaggccttctgcatggtctatgcagccctggggctgccagcctccttagctctcgtggccaccctgcgccattgcctgctgcctgtgctcagccgcccacgtgcctgggtagcggtccactggcagctgtcaccggccagggctgcgctgctgcaggcagttgcactgggactgctggtggccagcagctttgtgctgctgccagcgctggtgctgtggggccttcagggcgactgcagcctgctgggggccgtctacttctgcttcagctcgctcagcaccattggcctggaggacttgctgcccggccgcggccgcagcctgcaccccgtgatttaccacctgggccagctcgcacttcttggtggagggacctcactccagggcacggcgtgggaggggtagtcgaagagctctggtggcagcgttgagaagggggttacttgcttctaggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcataaaatgagcaacga

SEQ ID NO: 23154 - DNA, 445 bp, Homo sapiens
cctgcaccccgtgatttaccacctgggccagctcgcacttcttggtggagggacctcactccagggcacggcgtgggaggggtagtcgaagagctctggtggcagcgttgagaagggggactcttggccatgctgctggcagtggagaccttctctgagctgccgcaggtccgtgccatggggaagttcttcagacccagtggtcctgtgactgctgaggaccaaggtggcatcctagggcaggatgaactggctctgagcaccctgccgcccgcggccccagcttcaggacaagcccctgcttgctgaagcgtcaggtgaccgagttcagctccgtaaggtggcggcacctgaggaggaagcagccaggagtggctggggaagaatctggagatggagccgcggtgagggtgggcgggaggcctcagaggatactgttaatcat

SEQ ID NO: 23155 - DNA, 1303 bp, Homo sapiens
gtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggggaactaactgcacattcaagagaggcgtccgtggatgctgggtctcactgccaaagccgaacacggcttcgggatttctgccttctcaagtggacctctgctgtgctgggcg

SEQ ID NO: 23156 - DNA, 1441 bp, Homo sapiens
gtgggacgcgcgcggctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggtgtggggagggaaatgggacagaaaagtcatttgtcatagttggtgttaatttccattggtccaactcgtcttttcttatttatttattattattattgtcatcattattactttctctccttcctcctttcttggtctcttggtctcattttcccccacctttccagccagacagagcaggccaaagggaaatacaggcccatcctcctctgaaactcacatctgagcatgaagcatggatctcctcctt

SEQ ID NO: 23157 - DNA, 3276 bp, Homo sapiens
ctgtgagcctgcgggacatgccccccgcgccggctccttgctggcggccatgaagaggcagaacgtgcggactctgtccctcatcgtctgcaccttcacctacctgctggtgggcgccgccgtgttcgacgccctcgagtcggaccacgagatgcgcgaggaggagaaactcaaagccgaggagatccggatcaaggggaagtacaacatcagcagcgaggactaccggcagctggagctggtgatcctgcagtcggaaccgcaccgcgccggcgtccagtggaaattcgccggctccttctactttgcgatcacggtcatcaccaccataggttatgggcacgctgcacctggcaccgatgcgggcaaggccttctgcatgttctacgccgtgctgggcatcccgctgacactggtcatgttccagagcctgggcgagcgcatgaacaccttcgtgcgctacctgctgaagcgcattaagaagtgctgtggcatgcgcaacactgacgtgtctatggagaacatggtgactgtgggcttcttctcctgcatggggacgctgtgcatcggggcggccgccttctcccagtgtgaggagtggagcttcttccacgcctactactactgcttcatcacgttgactaccattgggttcggggactacgtggccctgcagaccaagggtgccctgcagaagaagccgctctacgtggcctttagctttatgtatatcctggtggggctgacggtcatcggggccttcctcaacctggtcgtcctcaggttcttgaccatgaacagtgaggatgagcggcgggatgctgaagagagggcatccctcgccggaaaccgcaacagcatggtcattcacatccctgaggagccgcggcccagccggcccaggtacaaggcggacgtcccggacctgcagtctgtgtgctcctgcacctgctaccgctcgcaggactatggcggccgctcggtggcaccgcagaactccttcagcgccaagcttgccccccactacttccactccatctcttacaagatcgaggagatctcaccaagcacattaaaaaacagcctcttcccatcgcctattagctccatctctcctgggttacacagctttaccgaccaccagaggctgatgaaacgccggaagtccgtttaggggaactaactgcacattcaagagaggcgtccgtggatgctgggtctcactgccaaagccgaacacggcttcgggatttctgccttctcaagtggacctctgctgtgctgggcgaatgctctactcattcccctacacaactgtggggatggtccagctacacatagacaggaagcccagagaaacgctcgatgtgagggtccccgcaagcccgtcgggctctttcggcacctggcccccccaaagctcctcaacgaggagtagagactgccaagcccttccactcattcatcatcataaaaatgtaacttgctatggcagcctcttggccattaagggctatactttgtgacctctgtccttgagatctttgctctgacaagttctatagccttctcagtgctgctatcgtgacgcagtgtccctgctgtggctaagtaacctttcgttttgatcaagatttgtccacgcagactcctacctctgcgcctttgcccgtgccgttcccactacctggaaggtctccccgttgctctccagctttgaggtggagacagagcatctcacacttccttttggtgtctcctgacccttttgctccctgctggacttggcgatgtcctcttctgggctcccctagtccttgttttggttgtgagcgaccgcaccagggagcaaaccttctatggccccggccacaggagcagcaagcactgggcagtgccccagacggaaggaccatcgcgagaataaaggcactgagatgtctggcatcttgcccaaatggccacttatcaccgtgattgaggcacgtcttaacttgctgaagtggaaacagggtaactcaatgcacgcctctgcaccatccctggaaaccaatccagatctatgagaagaaaactggtcatcatagcactggtgattcaacggcacctgcctggcagggtggagtgtgccccatacaacagggctggaagctgccacgccaggtatttctcataaggccggtacagggatggcaccagactatgggagcatacttgtgatgtcactctgaagaagttgggccccgtgatgggaatgtcatcaggaaactgggtccacactgttttcttgtggcaacacttctggtggaggctgcgaggggatggggacatgcaccatgagtgactcaggaacccccagcctctgtggcctggctcctgcccacccctagctctggggccttgagagaggcaagcacacgctcttctcgcctccagagagcggcgtgggggtgtggatactgctcaggccctggcatctcgcacgcctaggaccagcctctgccattcacaggaccgtgcaggcggccccaacagaggacggggacagctctctccttctgtaagtgaggcagcctcatccttccctggatcctcagcatctcttaaccagcagtggcagaggttgaattagaatggcaccagcttcggataaaaatccagatctcgcttttcaaaatgtgtctagagctggtggctgtaaggaaccagtcaagcctcagctgtgactctaatcctgccaagtccacctgagagccgactcattcatccaaagagagaacggtttggatggagctcaaggtgcctggctcgctggcatagcccagacaacctcttaaaggccgggccacagagctagaaggtctgtcactactcagttggggaaatcgtctgagaagttcaagtccactgcctcgcaactcaaatgagtcagcctcaccaaccaagaatcgcgttcataaacagactcagagcctgcgtgccgtggggtttccccgtctgcaactctctcacctggccctcctgcagggcccggcggggactggggagggtcagtgctccctggggcggggactgggtctgtttccaggctcagtgcctctgagtcatacagatgccaggtggtcctgctgcttaccctcgctgaacctcaggcttctcgtgtaaacagggcgcttttgaggaattattattaacatctccctgtgagtcaaagcacctactgagataatgtatgtgatgcttgtaataaatgcagctacatgccaggcactctga
